United States Patent 11,396,659 (NUCLEOTIDE SEQUENCES AND CORRESPONDING POLYPEPTIDES CONFERRING MODIFIED PHENOTYPE CHARACTERISTICS IN PLANTS) - sequence listing, part 3

SEQ ID NO: 5769 - protein, 342 aa, Arabidopsis thaliana
  misc_feature (1)..(342): useful for making plants with modified plant phenotypes as described in USSN 12/139,269
  misc_feature (48)..(110): Pfam Name: zf-Dof; Pfam Description: Dof domain, zinc finger
  misc_feature (1)..(342): Utility: Useful for delaying flowering time
  misc_feature (1)..(342): Utility: Useful for increasing chlorophyll and photosynthetic capacity
  misc_feature (1)..(342): Utility: Useful for making ornamental plants with modified leaves
  misc_feature (1)..(342): Utility: Useful for making plants with altered leaf shape eg curled leaves
  misc_feature (1)..(342): Utility: Useful for making plants with increased biomass
  misc_feature (1)..(342): Utility: Useful for making smaller plants
MDTAQWPQEIVVKPLEEIVTNTCPKPQPQPLQTQQPPSVGGERKARPEKDQAVNCPRCNSTNTKFCYYNNYSLTQPRYFCKGCRRYWTEGGSLRNIPVGGGSRKNKRSHSFSSDISNNHSDSTQPATKKHLSDHHHHLMSMSQQGLTGQNPKFLETTQQDLNLGFSPHGMIRTNFTDLIHNIGNNTNKSNNNNNPLIVSSCSTMATSSLDLIRNNSNNGNSSNSSFMGFPVHNEDPASGGFSMQDHYKPCNTNTTLLGFSLDHHHNNGFHGGFQGGEEGGEGGDDVNGRHLFPFEDLKLPVSSSSATINVDINEHQKRGSGSDAAATSGGYWTGMLSGGSWC

SEQ ID NO: 5770 - protein, 293 aa, Glycine max
  misc_feature (1)..(293): useful for making plants with modified plant phenotypes as described in USSN 12/139,269
  misc_feature (1)..(293): Ceres CLONE ID no. 476994
  misc_feature (1)..(293): Utility: Useful for delaying flowering time
  misc_feature (1)..(293): Utility: Useful for increasing chlorophyll and photosynthetic capacity
  misc_feature (1)..(293): Utility: Useful for making ornamental plants with modified leaves
  misc_feature (1)..(293): Utility: Useful for making plants with altered leaf shape eg curled leaves
  misc_feature (1)..(293): Utility: Useful for making plants with increased biomass
  misc_feature (1)..(293): Utility: Useful for making smaller plants
MVVKPIEDIVVTNTCPKAVESKPRPQKEQAINCPRCHSINTKFCYYNNYSLTQPRYFCKTCRRYWTEGGTLRNIPVGGGSRKNKRSSASCSTPNNSHNNNNSTNKKLLSDLVITPPTLSHTQNPNSNNTIHQGQDLNLAFPSSTPDFRKISELVQQNNNNNNSSNNSMSASASSSSTTTTTSTSHLSALELLTGITSSSSAGLTSFMPVPVPSDPNSIYTCGFPLQDFKPTLNFSLDGIGNGYTSLQNVQSGRLLFPSDDLRQVSSSTITTMDQKQQGDSTGYWTGMLGGGSW

SEQ ID NO: 5771 - DNA, 1417 bp, Arabidopsis thaliana
  misc_feature (1)..(1417): useful for making plants with modified plant phenotypes as described in USSN 12/139,269
  misc_feature (1)..(1417): Ceres CLONE ID no. 38101
  misc_feature (1)..(1417): Also known as  Ceres CDNA ID no. 23377274
attcgctccgtttctctctcaaaaactacacacacgtaccacaccaccaccctcctcgtttcctcagagatcccctctctaacttctaaggatatagaaaatggcagatggtgaagacattcagcctctcgtctgtgacaatggaaccggaatggttaaggctggatttgctggagatgatgcaccaagagctgtattccctagcatcgttggtcgtcctcgacacactggtgtcatggttggtatgggacaaaaagatgcttacgttggtgatgaggctcagtctaagagaggtattttgacattgaaatatcctattgagcatggtattgttagcaactgggatgatatggagaagatttggcatcacactttctacaatgagctccgtgttgcacctgaagaacaccctgttcttctcactgaggctcctctcaaccccaaggccaatcgtgagaaaatgactcagattatgtttgaaactttcaacactcctgccatgtatgtcgctatccaagctgttctttccctctacgctagtggtcgtactactggtattgtgttggactctggagatggtgtgagtcacactgttccaatttatgaaggatatgctcttccacatgctattctgcgtttggaccttgcaggccgtgaccttactgattacctcatgaagatcttaaccgagcgtggttactcattcactacctcagcagagcgtgaaatcgtaagggatgtgaaagagaaacttgcttacatagcacttgactacgagcaagagatggaaacagcaaacacaagctcatccgttgagaagagctatgagttgcctgatggacaggtgatcaccattggaggagagagattccgctgcccggaggttctgttccaaccgtctttggtgggaatggaagctgctggtattcacgagaccacttacaattccatcatgaagtgtgatgtggatatcaggaaggatctgtatggaaacattgtgctcagtggtggaaccaccatgttccctggaattgctgataggatgagcaaagagatcactgctttggctccaagcagcatgaagattaaggtggttgctccaccagagaggaagtacagtgtctggattggaggctccattctagcatcactcagtaccttccaacagatgtggatagcaaaggctgagtatgatgagtcagggccatcaatagtccacaggaagtgcttctaagattaagctcaaatcaaagtgatgaatgattgttctgtattggtaaagccttttgttcatcgactttgttgcaaaatattcttttgttttctatgtttcttcaccactacattacatttctttcttgttgttatcctcttttggtgtttctgctattaatcgaaaaagaaattttcttttctc

SEQ ID NO: 5772 - protein, 377 aa, Arabidopsis thaliana
  misc_feature (1)..(377): useful for making plants with modified plant phenotypes as described in USSN 12/139,269
  misc_feature (8)..(377): Pfam Name: Actin; Pfam Description: Actin
  misc_feature (8)..(377): Pfam Name: Actin; Pfam Description: Actin
  misc_feature (1)..(377): Utility: Useful for delaying flowering time
  misc_feature (1)..(377): Utility: Useful for increasing chlorophyll and photosynthetic capacity
  misc_feature (1)..(377): Utility: Useful for making plants with altered leaf shape eg curled leaves
  misc_feature (1)..(377): Utility: Useful for making plants with increased biomass
  misc_feature (1)..(377): Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTSAEREIVRDVKEKLAYIALDYEQEMETANTSSSVEKSYELPDGQVITIGGERFRCPEVLFQPSLVGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 5773 - protein, 360 aa, Zea mays
  misc_feature (1)..(360): useful for making plants with modified plant phenotypes as described in USSN 12/139,269
  misc_feature (1)..(360): Ceres CLONE ID no. 338602
  misc_feature (1)..(360): Utility: Useful for delaying flowering time
  misc_feature (1)..(360): Utility: Useful for increasing chlorophyll and photosynthetic capacity
  misc_feature (1)..(360): Utility: Useful for making plants with altered leaf shape eg curled leaves
  misc_feature (1)..(360): Utility: Useful for making plants with increased biomass
  misc_feature (1)..(360): Utility: Useful for making smaller plants
MVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDMKEKLAYIALDYDQEMETAKTSSSVEKSYELPDGQVITIGAERFRCPEVLFQPSFIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 5774 - protein, 360 aa, Zea mays
  misc_feature (1)..(360): useful for making plants with modified plant phenotypes as described in USSN 12/139,269
  misc_feature (1)..(360): Ceres CLONE ID no. 331439
  misc_feature (1)..(360): Utility: Useful for delaying flowering time
  misc_feature (1)..(360): Utility: Useful for increasing chlorophyll and photosynthetic capacity
  misc_feature (1)..(360): Utility: Useful for making plants with altered leaf shape eg curled leaves
  misc_feature (1)..(360): Utility: Useful for making plants with increased biomass
  misc_feature (1)..(360): Utility: Useful for making smaller plants
MVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYIALDYEQELETAKNSSSVEKSYELPDGQVITIGAERFRCPEVLFQPSMIGMEAAGIHETTYNSIMKCDVDIRKDLYGNIVLSGGSTMFPGIADRMSKEITSLAPSSMKIKVVAPPERKYSVWIGGSILASLSTFQQMWISKEEYDESGPAIVHRKCF

SEQ ID NO: 5775 - protein, 377 aa, Zea mays
  misc_feature (1)..(377): useful for making plants with modified plant phenotypes as described in USSN 12/139,269
  misc_feature (1)..(377): Ceres CLONE ID no. 294922
  misc_feature (1)..(377): Utility: Useful for delaying flowering time
  misc_feature (1)..(377): Utility: Useful for increasing chlorophyll and photosynthetic capacity
  misc_feature (1)..(377): Utility: Useful for making plants with altered leaf shape eg curled leaves
  misc_feature (1)..(377): Utility: Useful for making plants with increased biomass
  misc_feature (1)..(377): Utility: Useful for making smaller plants
MADSEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYIALDYEQELETAKNSSSVEKSYELPDGQVITIGAERFRCPEVLFQPSMIGMEAAGIHETTYNSIMKCDVDIRKDLYGNIVLSGGSTMFPGIADRMSKEITSLAPSSMKIKVVAPPERKYSVWIGGSILASLSTFQQMWISKEEYDESGPAIVHRKCF

SEQ ID NO: 5776 - protein, 360 aa, Arabidopsis thaliana
  misc_feature (1)..(360): useful for making plants with modified plant phenotypes as described in USSN 12/139,269
  misc_feature (1)..(360): Ceres CLONE ID no. 116045
  misc_feature (1)..(360): Utility: Useful for delaying flowering time
  misc_feature (1)..(360): Utility: Useful for increasing chlorophyll and photosynthetic capacity
  misc_feature (1)..(360): Utility: Useful for making plants with altered leaf shape eg curled leaves
  misc_feature (1)..(360): Utility: Useful for making plants with increased biomass
  misc_feature (1)..(360): Utility: Useful for making smaller plants
MVKAGFAGDDAPRAVFPSIVGRPRHTGVMVGMGQKDAYVGDEAQSKRGILTLKYPIEHGIVNNWDDMEKIWHHTFYNELRVAPEEHPILLTEAPLNPKANREKMTQIMFETFNAPAMYVAIQAVLSLYASGRTTGIVLDSGDGVSHTVPIYEGYALPHAILRLDLAGRDLTDALMKILTERGYSFTTTAEREIVRDIKEKLCYIALDYEQELETAKTSSSVEKNYELPDGQVITIGSERFRCPEVLYQPSMIGMENAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 5777 - protein, 360 aa, Zea mays
  misc_feature (1)..(360): useful for making plants with modified plant phenotypes as described in USSN 12/139,269
  misc_feature (1)..(360): Ceres CLONE ID no. 292789
  misc_feature (1)..(360): Utility: Useful for delaying flowering time
  misc_feature (1)..(360): Utility: Useful for increasing chlorophyll and photosynthetic capacity
  misc_feature (1)..(360): Utility: Useful for making plants with altered leaf shape eg curled leaves
  misc_feature (1)..(360): Utility: Useful for making plants with increased biomass
  misc_feature (1)..(360): Utility: Useful for making smaller plants
MVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYDQELENAKSSSSVEKSYELPDGQVITIGAERFRCPEVLFQPSFIGMEAPGIHETTYNSIMKCDVDIRKDLYGNIVLSGGTTMFPGIADRMSKEITALAPSSMKIKVVAPPERKYSVWIGGSILASLSTFQQMWISKAEYDESGPAIVHRKCF

SEQ ID NO: 5778 - protein, 360 aa, Zea mays
  misc_feature (1)..(360): useful for making plants with modified plant phenotypes as described in USSN 12/139,269
  misc_feature (1)..(360): Ceres CLONE ID no. 996136
  misc_feature (1)..(360): Utility: Useful for delaying flowering time
  misc_feature (1)..(360): Utility: Useful for increasing chlorophyll and photosynthetic capacity
  misc_feature (1)..(360): Utility: Useful for making plants with altered leaf shape eg curled leaves
  misc_feature (1)..(360): Utility: Useful for making plants with increased biomass
  misc_feature (1)..(360): Utility: Useful for making smaller plants
MVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALEYDQELENAKSSSSVEKSYELPDGQVITIGAERFRCPEVLFQPSFIGMEAPGIHETTYNSIMKCDVDIRKDLYGNIVLSGGTTMFPGIADRMSKEITALAPSSMKIKVVAPPERKYSVWIGGSILASLSTFQQMWISKAEYDESGPGIVHRKCF

SEQ ID NO: 5779 - protein, 360 aa, Brassica napus
  misc_feature (1)..(360): useful for making plants with modified plant phenotypes as described in USSN 12/139,269
  misc_feature (1)..(360): Ceres CLONE ID no. 1073372
  misc_feature (1)..(360): Utility: Useful for delaying flowering time
  misc_feature (1)..(360): Utility: Useful for increasing chlorophyll and photosynthetic capacity
  misc_feature (1)..(360): Utility: Useful for making plants with altered leaf shape eg curled leaves
  misc_feature (1)..(360): Utility: Useful for making plants with increased biomass
  misc_feature (1)..(360): Utility: Useful for making smaller plants
MVKAGFAGDDAPRAVFPSIVGRPRHTGVMVGMGQKDAYVGDEAQSKRGILTLKYPIEHGIVSNWDDMENIWHHTFYNELRVAPEEHPVLLTEAPLNPKANREKMTHIMFETFNVPAMYVAIQAVLSLYASGRTTGIVLDSGDGVSHTVPIYEGYALPHAILRLDLAGRDLTDSLMKILTERGYMFTTTAEREIVRDIKEKLAYVALDYEQELETAKSSSSVEKNYELPDGQVITIGAERFRCPEVLFQPSLVGMEAPGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 5780 - protein, 360 aa, Arabidopsis thaliana
  misc_feature (1)..(360): useful for making plants with modified plant phenotypes as described in USSN 12/139,269
  misc_feature (1)..(360): Ceres CLONE ID no. 41421
  misc_feature (1)..(360): Utility: Useful for delaying flowering time
  misc_feature (1)..(360): Utility: Useful for increasing chlorophyll and photosynthetic capacity
  misc_feature (1)..(360): Utility: Useful for making plants with altered leaf shape eg curled leaves
  misc_feature (1)..(360): Utility: Useful for making plants with increased biomass
  misc_feature (1)..(360): Utility: Useful for making smaller plants
MVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNTPAMYVAIQAVLSLYASGRTTGIFLDSGDGVSHTVPIYEGYALPHAILRLDLAGRDLTDHLMKILTERGYSFTTTAEREIVRDMKEKLSYIALDFEQELETSKTSSSVEKSFELPDGQVITIGAERFRCPEVLFQPSMIGMENPGIHETTYNSIMKCDVDIRKDLYGNIVLSGGTTMFGGIGDRMSKEITALAPSSMKIKVVAPPERKYSVWIGGSILASLSTFQQMWIAKAEYDESGPSIVHRKCF

SEQ ID NO: 5781 - protein, 360 aa, Zea mays
  misc_feature (1)..(360): useful for making plants with modified plant phenotypes as described in USSN 12/139,269
  misc_feature (1)..(360): Ceres CLONE ID no. 1549130
  misc_feature (1)..(360): Utility: Useful for delaying flowering time
  misc_feature (1)..(360): Utility: Useful for increasing chlorophyll and photosynthetic capacity
  misc_feature (1)..(360): Utility: Useful for making plants with altered leaf shape eg curled leaves
  misc_feature (1)..(360): Utility: Useful for making plants with increased biomass
  misc_feature (1)..(360): Utility: Useful for making smaller plants
MVKAGFAGDDAPRAVFPSIVGRPRHTGVMVGMGQKDAYVGDEAQSKRGILTLKYPIEHGIVGNWDDMEKIWHHTFYNELRVAPEEHPILLTEAPLNPKANREKMTQIMFETFNCPAMYVAIQAVLSLYASGRTTGIVLDSGDGVSHTVPIYEGYTLPHAILRLDLAGRDLTDNLMKILTERGYSFTTTAEREIVRDIKEKLAYVALDYEQELETARTSSSVEKSYELPDGQVITIGAERFRCPEVLFQPSFIGMESAGIHEATYNSIMKCDVDIRKDLYGNVVLSGGSTMFPGIGDRMSKEITALAPSSMKVKVVAPPERKYSVWIGGSILASLSTFQQMWISKEEYDESGPGIVHMKCF

SEQ ID NO: 5782 - protein, 360 aa, Arabidopsis thaliana
  misc_feature (1)..(360): useful for making plants with modified plant phenotypes as described in USSN 12/139,269
  misc_feature (1)..(360): Ceres CLONE ID no. 34479
  misc_feature (1)..(360): Utility: Useful for delaying flowering time
  misc_feature (1)..(360): Utility: Useful for increasing chlorophyll and photosynthetic capacity
  misc_feature (1)..(360): Utility: Useful for making plants with altered leaf shape eg curled leaves
  misc_feature (1)..(360): Utility: Useful for making plants with increased biomass
  misc_feature (1)..(360): Utility: Useful for making smaller plants
MVKAGFAGDDAPRAVFPSVVGRPRHHGVMVGMNQKDAYVGDEAQSKRGILTLKYPIEHGVVSNWDDMEKIWHHTFYNELRIAPEEHPVLLTEAPLNPKANREKMTQIMFETFNSPAMYVAIQAVLSLYASGRTTGIVLDSGDGVSHTVPIYEGFSLPHAILRLDLAGRDLTDYLMKILTERGYMFTTTAEREIVRDIKEKLSFVSVDYEQEMETSKTSSSIEKNYELPDGQVITIGAERFRCPEVLFQPSFVGMEAAGIHETTYNSIMKCDVDIRKDLYGNIVLSGGTTMFSGIADRMSKEITALAPSSMKIKVVAPPERKYSVWIGGSILASLSTFQQMWISKAEYDEAGPGIVHRKCF

SEQ ID NO: 5783 - protein, 360 aa, Zea mays
  misc_feature (1)..(360): useful for making plants with modified plant phenotypes as described in USSN 12/139,269
  misc_feature (1)..(360): Ceres CLONE ID no. 223048
  misc_feature (1)..(360): Utility: Useful for delaying flowering time
  misc_feature (1)..(360): Utility: Useful for increasing chlorophyll and photosynthetic capacity
  misc_feature (1)..(360): Utility: Useful for making plants with altered leaf shape eg curled leaves
  misc_feature (1)..(360): Utility: Useful for making plants with increased biomass
  misc_feature (1)..(360): Utility: Useful for making smaller plants
MVKAGFAGDDAPRAVFPSIVGRPRHTGVMVGMGQKDAYVGDEAQAKRGILTLKYPIEHGIVNNWDDMEKIWHHTFYNELRVSPEDHPVLLTEAPLNPKANREKMTQIMFETFECPAIYVAIQAVLSLYASGRTTGIVMDSGDGVSHTVPIYEGYTLPHAILRLDLAGRDLTDHLMKILTERGYSLTTSAEREIVRDIKEKLAYVALDYEQELETARSSSSVEKSYEMPDGQVITIGSERFRCPEVLFQPSLVGMESPGVHEATYNSIMKCDVDIRKDLYGNVVLSGGSTMFPGIADRMSKEITSLAPSSMKVKVIAPPERKYSVWIGGSILASLSTFQQMWISKGEYDETGPGIVHMKCF

SEQ ID NO: 5784 - DNA, 1623 bp, Arabidopsis thaliana
  misc_feature (1)..(1623): useful for making plants with modified plant phenotypes as described in USSN 12/139,269
  misc_feature (1)..(1623): Ceres CLONE ID no. 38419
  misc_feature (1)..(1623): Also known as  Ceres CDNA ID no. 23358368
ccgagattacagagaaccccgtcccgtgtttaaaccctccggcgacaaagctcagatagagaaccgctccacccttgtcgttctctgcagccatgtacggcggagatgaagtgtcagctattgtggttgacttgggttcgcacacttgcaaggctggttacgccggtgaagatgctcccaaggccgttttcccttccgttattggggcagtagatggtgtagaggcaatggatgtggatgttgattctacaaagactaattcgaactctgaggattcgaagaccgagtctgaaaaggaaaagggcaaacgcaagctctatgtaggatctcaagccatgagctaccgcagagatcatatggaggttttgtcacctataaaagatggcatcgtttctgactgggatttggtggacaatatatgggaacatgctttcaagagttgtctgatgattgatcctacggagcatccaatgctgctagctgagcctcctttaaacactcaacagcagagagagaaggcggcagagctaatgtttgaaaagtacaaagttccggcactgtttatggctaagaaccctgttctcacgtcttttgctactgggcgtgctacttctttggttgttgactgcggtggaggatccacaaccatttcaccggtgcatgatggttatgttcttcagaaggctgttgtatcgtctccacttggaggggaatttctcactgactgcctactgaaaagcttggagagtaaaggaattaaaataagacctagatactctttcaagaggaaggaagtacgagcaggggaattccaggttgaagatgtggatattcctgacaccacggaaagctacaaactcttctgccagaggatgatagtgggtgatatcaaggattctatttgtcgagttcctgatactccctatgacgataaatcatattcaaacatccctactacgtcgtacgagcttcctgatggccagacgctcgagattggtgctgataggttcaaagttcctgatgtgatgttcaacccgtccatagtccagacgattcctggaatggagaagtatgctgatatgattccttccgttcgtgggttaccacacatggtcatggagagcatcaacaaatgtgatgtagacatccggagagagttgtatagtagcatactgcttgctggtggcacatcgtcaatgcaacagctgaaagaacgtctcgaaaaggacttgatcgaagagtctcctcactcagctagagttaaagtgttggcaagcggtaacacaacagaaagaagattcagtgtatggataggagggagtatattggcatcactaggctcatttcaacagatgtggttctccaagtctgagtatgaggaacatggagcttcctacattcagagaaaatgcccttaaagcaggcagtttcagattatgtggagtctgacaagacgaaacttggaaactaatgtgttattttcattgtgcatcgttgttccttgaagattattagtattccgcctgaaccttttagaatgagtgtcattaacaagcattatagtgctatttttaaaacataaaaacatgtggaagaagtttcgttgctttattagattttcgc

SEQ ID NO: 5785 - protein, 441 aa, Arabidopsis thaliana
  misc_feature (1)..(441): useful for making plants with modified plant phenotypes as described in USSN 12/139,269
  misc_feature (8)..(223): Pfam Name: Actin; Pfam Description: Actin
  misc_feature (8)..(223): Pfam Name: Actin; Pfam Description: Actin
  misc_feature (1)..(441): Utility: Useful for delaying flowering time
  misc_feature (1)..(441): Utility: Useful for increasing chlorophyll and photosynthetic capacity
  misc_feature (1)..(441): Utility: Useful for making ornamental plants with modified leaves
  misc_feature (1)..(441): Utility: Useful for making plants that grow better in shade
  misc_feature (1)..(441): Utility: Useful for making plants with altered leaf shape eg curled leaves
  misc_feature (1)..(441): Utility: Useful for making plants with increased biomass
  misc_feature (1)..(441): Utility: Useful for making plants with increased biomass and foliage
  misc_feature (1)..(441): Utility: Useful for making smaller plants
MYGGDEVSAIVVDLGSHTCKAGYAGEDAPKAVFPSVIGAVDGVEAMDVDVDSTKTNSNSEDSKTESEKEKGKRKLYVGSQAMSYRRDHMEVLSPIKDGIVSDWDLVDNIWEHAFKSCLMIDPTEHPMLLAEPPLNTQQQREKAAELMFEKYKVPALFMAKNPVLTSFATGRATSLVVDCGGGSTTISPVHDGYVLQKAVVSSPLGGEFLTDCLLKSLESKGIKIRPRYSFKRKEVRAGEFQVEDVDIPDTTESYKLFCQRMIVGDIKDSICRVPDTPYDDKSYSNIPTTSYELPDGQTLEIGADRFKVPDVMFNPSIVQTIPGMEKYADMIPSVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 5786 - protein, 102 aa, Brassica napus
  misc_feature (1)..(102): useful for making plants with modified plant phenotypes as described in USSN 12/139,269
  misc_feature (1)..(102): Ceres CLONE ID no. 1125315
  misc_feature (1)..(102): Utility: Useful for delaying flowering time
  misc_feature (1)..(102): Utility: Useful for increasing chlorophyll and photosynthetic capacity
  misc_feature (1)..(102): Utility: Useful for making ornamental plants with modified leaves
  misc_feature (1)..(102): Utility: Useful for making plants that grow better in shade
  misc_feature (1)..(102): Utility: Useful for making plants with altered leaf shape eg curled leaves
  misc_feature (1)..(102): Utility: Useful for making plants with increased biomass
  misc_feature (1)..(102): Utility: Useful for making plants with increased biomass and foliage
  misc_feature (1)..(102): Utility: Useful for making smaller plants
MYGGDEVSAIVVDLGSHTCKAGYAGEDAPKAVFPSVVGAVDGVEAMEVDVDSAKTNSNSEDKSEKDKGKRKLCVGSQALNYRRDHMEILSPIKDGIVSDWDL

SEQ ID NO: 5787 - protein, 443 aa, Zea mays
  misc_feature (1)..(443): useful for making plants with modified plant phenotypes as described in USSN 12/139,269
  misc_feature (1)..(443): Ceres CLONE ID no. 319835
  misc_feature (1)..(443): Utility: Useful for delaying flowering time
  misc_feature (1)..(443): Utility: Useful for increasing chlorophyll and photosynthetic capacity
  misc_feature (1)..(443): Utility: Useful for making ornamental plants with modified leaves
  misc_feature (1)..(443): Utility: Useful for making plants that grow better in shade
  misc_feature (1)..(443): Utility: Useful for making plants with altered leaf shape eg curled leaves
  misc_feature (1)..(443): Utility: Useful for making plants with increased biomass
  misc_feature (1)..(443): Utility: Useful for making plants with increased biomass and foliage
  misc_feature (1)..(443): Utility: Useful for making smaller plants
MYGGDEVSAIVIDVGSYSCKAGYAGDDTPKAVFPSVVGSIEQTEDTDDPKPEKEADSASDSKNGAKPMDVDKAKTKRRLYVGQELEFRRDHMEVISSMKDGTVTDWDIVDNIWNHAFRRRLLINPEEHPMLIAEPSTNTAQQREKAAELIFENYKVPALFLAKNAVLTSFASGRATSLVVDSGGGSTVVSAVHDGFVLQKSVSTSPVGGEFLTDCMMKSLESKGIVIRPRYSFKKKEISPGEYKIVDLDLPNTTESYRLYCMRAIASDVKESVCRVPDTAFDEVAYANVPTTSYELPDGQTIEVGADRFKVPDILFNPSLSQTIPGIDGFADSIPVRGLQRMVIDSVNKCDVDIRKELFSNILLSGGSSSILQLKERLEKEVLEESPQAARVKVMASGNSVERRFSVWIGGSILASLGSFQQMWFSKAEYEEHGVSYIQRKCP

SEQ ID NO: 5788 - protein, 128 aa, Brassica napus
  misc_feature (1)..(128): useful for making plants with modified plant phenotypes as described in USSN 12/139,269
  misc_feature (1)..(128): Ceres CLONE ID no. 944775
  misc_feature (1)..(128): Utility: Useful for delaying flowering time
  misc_feature (1)..(128): Utility: Useful for increasing chlorophyll and photosynthetic capacity
  misc_feature (1)..(128): Utility: Useful for making ornamental plants with modified leaves
  misc_feature (1)..(128): Utility: Useful for making plants that grow better in shade
  misc_feature (1)..(128): Utility: Useful for making plants with altered leaf shape eg curled leaves
  misc_feature (1)..(128): Utility: Useful for making plants with increased biomass
  misc_feature (1)..(128): Utility: Useful for making plants with increased biomass and foliage
  misc_feature (1)..(128): Utility: Useful for making smaller plants
  misc_feature (119)..(119): Xaa is any aa, unknown or other
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANRXEDDPDYVRD

SEQ ID NO: 5789 - protein, 142 aa, Brassica napus
  misc_feature (1)..(142): useful for making plants with modified plant phenotypes as described in USSN 12/139,269
  misc_feature (1)..(142): Ceres CLONE ID no. 1078589
  misc_feature (1)..(142): Utility: Useful for delaying flowering time
  misc_feature (1)..(142): Utility: Useful for increasing chlorophyll and photosynthetic capacity
  misc_feature (1)..(142): Utility: Useful for making ornamental plants with modified leaves
  misc_feature (1)..(142): Utility: Useful for making plants that grow better in shade
  misc_feature (1)..(142): Utility: Useful for making plants with altered leaf shape eg curled leaves
  misc_feature (1)..(142): Utility: Useful for making plants with increased biomass
  misc_feature (1)..(142): Utility: Useful for making plants with increased biomass and foliage
  misc_feature (1)..(142): Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNAPAMYVAIQAVL

SEQ ID NO: 5790 - protein, 136 aa, Brassica napus
  misc_feature (1)..(136): useful for making plants with modified plant phenotypes as described in USSN 12/139,269
  misc_feature (1)..(136): Ceres CLONE ID no. 1067464
  misc_feature (1)..(136): Utility: Useful for delaying flowering time
  misc_feature (1)..(136): Utility: Useful for increasing chlorophyll and photosynthetic capacity
  misc_feature (1)..(136): Utility: Useful for making ornamental plants with modified leaves
  misc_feature (1)..(136): Utility: Useful for making plants that grow better in shade
  misc_feature (1)..(136): Utility: Useful for making plants with altered leaf shape eg curled leaves
  misc_feature (1)..(136): Utility: Useful for making plants with increased biomass
  misc_feature (1)..(136): Utility: Useful for making plants with increased biomass and foliage
  misc_feature (1)..(136): Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNTPAMYV

SEQ ID NO: 5791 - DNA, 468 bp, Arabidopsis thaliana
  misc_feature (1)..(468): useful for making plants with modified plant phenotypes as described in USSN 12/139,269
  misc_feature (1)..(468): Ceres CLONE ID no. 38470
  misc_feature (1)..(468): Also known as  Ceres CDNA ID no. 23371695
atagaatataaccatattccggacatgaagatcgtgacattggtactcgtcgtcttcgtcatactttcgacatcattcccggctgccatcaaagccgaagacacgggagatacaggaaatgtgggagtgacatgtgacgcaaggcagcttcagccttgccttgccgcgattacgggaggaggacaaccctcgggtgcatgttgtgcaaagcttacagagcaacagtcatgcctatgtggtttcgctaagaaccctgcgttcgcacagtacattagctctccaaacgctcgcaaagtgctccttgcttgcaatgttgcttatcccacttgttgaaacttatctagattttataaataaataaacgaaaggaaataaattacattatatcaaacgttatgatacaattcaaccgtttgtgttaatgtactggcttacatggttaaataaagtttaatttcttggttgctc

SEQ ID NO: 5792 - protein, 102 aa, Arabidopsis thaliana
  misc_feature (1)..(102): useful for making plants with modified plant phenotypes as described in USSN 12/139,269
  misc_feature (37)..(102): Pfam Name: Tryp_alpha_amyl; Pfam Description: Protease inhibitor/seed storage/LTP family
  misc_feature (37)..(102): Pfam Name: Tryp_alpha_amyl; Pfam Description: Protease inhibitor/seed storage/LTP family
  misc_feature (1)..(102): Utility: Useful for delaying flowering time
  misc_feature (1)..(102): Utility: Useful for making smaller plants
MKIVTLVLVVFVILSTSFPAAIKAEDTGDTGNVGVTCDARQLQPCLAAITGGGQPSGACCAKLTEQQSCLCGFAKNPAFAQYISSPNARKVLLACNVAYPTC

SEQ ID NO: 5793 - protein, 95 aa, Brassica napus
  misc_feature (1)..(95): useful for making plants with modified plant phenotypes as described in USSN 12/139,269
  misc_feature (1)..(95): Ceres CLONE ID no. 1087891
  misc_feature (1)..(95): Utility: Useful for delaying flowering time
  misc_feature (1)..(95): Utility: Useful for making smaller plants
MVLTLMVFVILLTSFPVPNKAADTNVEAACDPKQLQPCLAAITGGGQPSGDCCAKLKEQQPCLCGFAKNPAFAQYISSPNSRKVLTACGIPYPSC

SEQ ID NO: 5794 - protein, 95 aa, Brassica napus
  misc_feature (1)..(95): useful for making plants with modified plant phenotypes as described in USSN 12/139,269
  misc_feature (1)..(95): Ceres CLONE ID no. 946439
  misc_feature (1)..(95): Utility: Useful for delaying flowering time
  misc_feature (1)..(95): Utility: Useful for making smaller plants
MKILALTLTVFVILSPSFASPTKVALGAACDAKQLQPCLAAITGGGQPSGDCCAKLKEQQPCLCGFSKNPAFAQYVSSPNSRKVVSACGVPYPSC

SEQ ID NO: 5795 - protein, 89 aa, Parthenium argentatum
  misc_feature (1)..(89): useful for making plants with modified plant phenotypes as described in USSN 12/139,269
  misc_feature (1)..(89): Ceres CLONE ID no. 1610064
  misc_feature (1)..(89): Utility: Useful for delaying flowering time
  misc_feature (1)..(89): Utility: Useful for making smaller plants
MAAAYALLVMILAGYAETTNAATCSVTELSPCISSFTTSAPPSAQCCAKLKQQQPCLCGYIKNPSLKQYVNSPNAKKVSSTCGVPFPKC

SEQ ID NO: 5796 - protein, 102 aa, Parthenium argentatum
  misc_feature (1)..(102): useful for making plants with modified plant phenotypes as described in USSN 12/139,269
  misc_feature (1)..(102): Public GI no. 45593274
  misc_feature (1)..(102): Utility: Useful for delaying flowering time
  misc_feature (1)..(102): Utility: Useful for making smaller plants
MKFTTLMLITFVIIAMSSPVPIRATRVESFGEVAQSCVVTELAPCLPAMTLTGDPTTECCDKLVEQKPCLCGYIRNPAYSMYVTSPNARKVLDFCKVPFPSC

SEQ ID NO: 5797 - protein, 103 aa, Parthenium argentatum
  misc_feature (1)..(103): useful for making plants with modified plant phenotypes as described in USSN 12/139,269
  misc_feature (1)..(103): Public GI no. 28973415
  misc_feature (1)..(103): Utility: Useful for delaying flowering time
  misc_feature (1)..(103): Utility: Useful for making smaller plants
MKFTGVVFILFVLGTMLSPVPVKARVVKGSGEEVNVTCDATQLSSCVTAVSTGAPPSTDCCGKLKEHETCLCTYIQNPLYSSYVTSPNARKTLAACDVAYPTC

SEQ ID NO: 5798 - protein, 91 aa, Zea mays
  misc_feature (1)..(91): useful for making plants with modified plant phenotypes as described in USSN 12/139,269
  misc_feature (1)..(91): Ceres CLONE ID no. 1061228
  misc_feature (1)..(91): Utility: Useful for delaying flowering time
  misc_feature (1)..(91): Utility: Useful for making smaller plants
MFVAALALVVVMATTSTGGGRAAAACDPKPLVVCDPAFMDGAKPAAACCSTLRAQEACLCVYAKDPKFAKYINNPNTAKTFTSCGIAIPKC

SEQ ID NO: 5799 - DNA, 1641 bp, Arabidopsis thaliana
  misc_feature (1)..(1641): useful for making plants with modified plant phenotypes as described in USSN 12/139,269
  misc_feature (1)..(1641): Ceres CLONE ID no. 38690
  misc_feature (1)..(1641): Also known as  Ceres CDNA ID no. 23358357
  misc_feature (437)..(437): s is g or c
  misc_feature (438)..(438): s is g or c
acattccacaactctctctctctctcatttcttcgtataaaaggaaatctatatcatctctctctctctcattgtcaaaactcaaaagtatatacttttagtagttttagacttaataaatgcgatcgccctttttttagtatgttgaacctcattgctttcctccgccgtcgtctccgccgtccccggaaagccagaatctccgtcaaccaccaccacctctcagttgattcttctcctgagactcatcatcatcaaaatggcttttcatcggcagccgccatccacccaaacccggacaaaaccatcacagtggccacctttaacgctgctatgttctccatggctcccgccgtccctagcaacaagggcttgccattccggtccaagtctacggttgaccgccccaagagcattctcaagcccatgaacgccgssgcatctcctactcacgactctagaaagcaacagaggtttgccaaatccaggcctaggagagtctccatcaatctccccgacaacgagatcagccgccagctcagcttccgggaggatccacagcactctcccctcaggcccggcgagatcggtctccggagcaccagaacggctctggaagttctgagtgagctagacgcagacgtgctggctcttcaagacgtcaaggcggacgaggctgaccaaatgagaccgctctccgatctcgctgcggcgctggggatgaattacgtcttcgccgagagctgggcgccggagtacggcaacgccattctctctaagtggcccatcaaaagctccaatgttctaagaatcttcgaccacactgatttcaggaacgtgttgaaggcgagcatagaggttcccgggagcggggaagtggagtttcactgcactcatctggatcacttggacgagaagtggagaatgaagcaagtcgatgccattatccaatccaccaacgtaccgcacatactcgctggtgctctcaattctctcgacgaatccgattattctcctgagagatggaccgacatcgtcaagtattacgaagagatgggtaagccaataccaaaagcacaagtgatgagattcttaaagagcaaagaatacactgacgctaaggactttgctggagaatgcgaatctgtggttgttgtcgccaaaggccaaagtgtgcaggggacatgcaagtacgggacacgcgtggactacatacttgcttcctccgattcaccgtaccggttcgtgccagggtcgtattccgtgttgtcttccaaaggaacctcggaccatcacatagtcaaagtcgatgttgtaaaagctacatcgatcaacgtcaacgagcaggagcagcgaccgataagatcacataagctgcagagaattacagcgactacgtataataataactcgtctctcacaaaggcctcgtggaggacacactactataaagcatgaacaatcaacatatatattacaaaatgttacaggttttttttcgactgttggttgattaacacaatttgagatctgtgtatagttaataatcgtgctagtctctgtgttgaacgtgaagtctgatatacttttgcctagatttccattttttctacatcctaattttggtctgcttttaatgtc

SEQ ID NO: 5800 - protein, 438 aa, Arabidopsis thaliana
  misc_feature (1)..(438): useful for making plants with modified plant phenotypes as described in USSN 12/139,269
  misc_feature (56)..(391): Pfam Name: Exo_endo_phos; Pfam Description: Endonuclease/Exonuclease/phosphatase family
  misc_feature (56)..(391): Pfam Name: Exo_endo_phos; Pfam Description: Endonuclease/Exonuclease/phosphatase family
  misc_feature (1)..(438): Utility: Useful for delaying flowering time
  misc_feature (1)..(438): Utility: Useful for increasing chlorophyll and photosynthetic capacity
  misc_feature (1)..(438): Utility: Useful for making ornamental plants with modified flowers
  misc_feature (1)..(438): Utility: Useful for making ornamental plants with modified leaves
  misc_feature (1)..(438): Utility: Useful for making plants that grow better in shade
  misc_feature (1)..(438): Utility: Useful for making plants with altered leaf shape eg curled leaves
  misc_feature (1)..(438): Utility: Useful for making plants with increased biomass and foliage
MLNLIAFLRRRLRRPRKARISVNHHHLSVDSSPETHHHQNGFSSAAAIHPNPDKTITVATFNAAMFSMAPAVPSNKGLPFRSKSTVDRPKSILKPMNAAASPTHDSRKQQRFAKSRPRRVSINLPDNEISRQLSFREDPQHSPLRPGEIGLRSTRTALEVLSELDADVLALQDVKADEADQMRPLSDLAAALGMNYVFAESWAPEYGNAILSKWPIKSSNVLRIFDHTDFRNVLKASIEVPGSGEVEFHCTHLDHLDEKWRMKQVDAIIQSTNVPHILAGALNSLDESDYSPERWTDIVKYYEEMGKPIPKAQVMRFLKSKEYTDAKDFAGECESVVVVAKGQSVQGTCKYGTRVDYILASSDSPYRFVPGSYSVLSSKGTSDHHIVKVDVVKATSINVNEQEQRPIRSHKLQRITATTYNNNSSLTKASWRTHYYKA

SEQ ID NO: 5801 - protein, 443 aa, Arabidopsis thaliana
  misc_feature (1)..(443): useful for making plants with modified plant phenotypes as described in USSN 12/139,269
  misc_feature (1)..(443): Public GI no. 34898868
  misc_feature (1)..(443): Utility: Useful for delaying flowering time
  misc_feature (1)..(443): Utility: Useful for increasing chlorophyll and photosynthetic capacity
  misc_feature (1)..(443): Utility: Useful for making ornamental plants with modified flowers
  misc_feature (1)..(443): Utility: Useful for making ornamental plants with modified leaves
  misc_feature (1)..(443): Utility: Useful for making plants that grow better in shade
  misc_feature (1)..(443): Utility: Useful for making plants with altered leaf shape eg curled leaves
  misc_feature (1)..(443): Utility: Useful for making plants with increased biomass and foliage
MLRRVLAGFRALHPRPRRRRHGGAEGKARVTVRRLGSNGRKEAAAAAAGARRDNRGDGATGEAVTIRVATFNAAMFSMAPAVAAASSAETATETARRVTTPAAGGGRRPKGILKAQASLARTASKARVSINLQDNEISRERSKLGSTAARSTTTATTTPAATQQLNGGAEGRRRSVEEVLREVGADIIGLQNVRAEEERGMSPLSELAEGLGMRYVFAESWAPEYGNAVLSRWPIKRWKSQRVADQSDFNVLRATIEVPRAGEVNFHCTHLDHLDESWRMKQMNAILRSSDGPHILTGGLNALDGTDYSDERWADIVKYYEEIGKPTPKAEVMKYLKGKQYVDAKDFAGECEAVVVVAKGQVQGTCKYGTRVDYILASPNSPYKFVPGSYTVISSKGTSDHHIVKVDVTIQDKKETDEESGNQRQRVVKINKKCSKKGLWAAK

SEQ ID NO: 5802 - protein, 458 aa, Arabidopsis thaliana
  misc_feature (1)..(458): useful for making plants with modified plant phenotypes as described in USSN 12/139,269
  misc_feature (1)..(458): Public GI no. 11994389
  misc_feature (1)..(458): Utility: Useful for delaying flowering time
  misc_feature (1)..(458): Utility: Useful for increasing chlorophyll and photosynthetic capacity
  misc_feature (1)..(458): Utility: Useful for making ornamental plants with modified flowers
  misc_feature (1)..(458): Utility: Useful for making ornamental plants with modified leaves
  misc_feature (1)..(458): Utility: Useful for making plants that grow better in shade
  misc_feature (1)..(458): Utility: Useful for making plants with altered leaf shape eg curled leaves
  misc_feature (1)..(458): Utility: Useful for making plants with increased biomass and foliage
MLCVFRRKLGCLFSRLRWVIKKRVRARVIVRRFRKARWRARRKESPESEVSSIHLSSNSGRHIRVATFNVAMFSLAPVVQTMEETAFLGHLDSSNITCPSPKGILKQSPLHSSAVRKPKVCINLPDNEISLAQSYSFLSMVENDNDGKENRGSLSMRSPVCLPSCWWDQESFNGYSSRRSIAELLRELDADILALQDVKAEEETLMKPLSDLASALGMKYVFAESWAPEYGNAILSKWPIKKWRVQRIADVDDFRNVLKVTVEIPWAGDVNVYCTQLDHLDENWRMKQIDAITRGDESPHILLGGLNSLDGSDYSIARWNHIVKYYEDSGKPTPRVEVMRFLKGKGYLDSKEFAGECEPVVIIAKGQNVQGTCKYGTRVDYILASPESPYEFVPGSYSVVSSKGTSDHHIVKVDLVITKERSRGNFKHSRKKAKQKIFQIKANLMSKDTWKLGNLMSS

SEQ ID NO: 5803 - DNA, 840 bp, Arabidopsis thaliana
  misc_feature (1)..(840): useful for making plants with modified plant phenotypes as described in USSN 12/139,269
  misc_feature (1)..(840): Ceres CLONE ID no. 39286
  misc_feature (1)..(840): Also known as  Ceres CDNA ID no. 23428165
ttttttcgttcgactcatctccaaagagaagcttcaaaaaatggcttgcaaaacgattttgcgttccgttttcgtatcggaatcacgacggacttccggcgcacgtagatgcttctttctccctccttctccagcatcagttccagtccatggtttgttcccggcgccaaagagtctatgtttcaatggttttgcatctgttcccgagcgggctactcggcttaattgcagccataacgatcaatccgatcaaggtccgcctcaagaagctgttctcaaggcaatctcagaagtgtcaaagactgatgggagggttgggaaaactactaacatgattattggaggcactgtggctgatgattctgctaaagattggctcgaacttgaccaaaaggtcaatacatacccaacagaaagagggtttactgcaattgggactggtggcaatgactttgtgcatgctatggttgttgctgttgaatctgttattgaccgacaaattccagaggactgtgtaaagcagactttatcaagcaaaggaaaatatgtgtcggtgaatattggccctatccaagtcgtctctagtgagcaggttcaagctgtgtataatgcaatgaggagagacgaaagaatgaaatacttcttgtaggtttgaagtgtgtagaatcacgggtcttctcttttctatcttctccattgcgactatgtaaattatgcagtgtaaggccaccattaattattatttatacttatctacactaacttctgttagacactccttagacagtgtcttatgcatctgaaggaattagtggatatatcaaaaaatgacttataccc

SEQ ID NO: 5804 - protein, 202 aa, Arabidopsis thaliana
  misc_feature (1)..(202): useful for making plants with modified plant phenotypes as described in USSN 12/139,269
  misc_feature (111)..(202): Pfam Name: DUF493; Pfam Description: Protein of unknown function (DUF493)
  misc_feature (1)..(202): Utility: Useful for delaying flowering time
  misc_feature (1)..(202): Utility: Useful for increasing chlorophyll and photosynthetic capacity
  misc_feature (1)..(202): Utility: Useful for making ornamental plants with modified leaves
  misc_feature (1)..(202): Utility: Useful for making plants sterile and for genetic confinement
  misc_feature (1)..(202): Utility: Useful for making plants with increased biomass and foliage
  misc_feature (1)..(202): Utility: Useful for making smaller plants
MACKTILRSVFVSESRRTSGARRCFFLPPSPASVPVHGLFPAPKSLCFNGFASVPERATRLNCSHNDQSDQGPPQEAVLKAISEVSKTDGRVGKTTNMIIGGTVADDSAKDWLELDQKVNTYPTERGFTAIGTGGNDFVHAMVVAVESVIDRQIPEDCVKQTLSSKGKYVSVNIGPIQVVSSEQVQAVYNAMRRDERMKYFL

SEQ ID NO: 5805 - protein, 204 aa, Brassica napus
  misc_feature (1)..(204): useful for making plants with modified plant phenotypes as described in USSN 12/139,269
  misc_feature (1)..(204): Ceres CLONE ID no. 967750
  misc_feature (1)..(204): Utility: Useful for delaying flowering time
  misc_feature (1)..(204): Utility: Useful for increasing chlorophyll and photosynthetic capacity
  misc_feature (1)..(204): Utility: Useful for making ornamental plants with modified leaves
  misc_feature (1)..(204): Utility: Useful for making plants sterile and for genetic confinement
  misc_feature (1)..(204): Utility: Useful for making plants with increased biomass and foliage
  misc_feature (1)..(204): Utility: Useful for making smaller plants
  misc_feature (182)..(182): Xaa is any aa, unknown or other
  misc_feature (203)..(203): Xaa is any aa, unknown or other
MACKTILRSVFISESRRASAASRCFFIPPSLSASGPVPGLFPAPKGLSFNNFASLPDRRLPRLNCTLSNDQSEQGPPQEAVLKAISVSKTDGRVGKTTNMIIGGTVADDSAQDWLELDQKVNTYPTDRGFTAIGTGGDDFVHAMVVAVESVIERQIPEDCVKQTLSSKGKYVSVNIGPIRVXSSEQVQAVYNAMRRDERMKYXL

SEQ ID NO: 5806 - protein, 180 aa, Glycine max
  misc_feature (1)..(180): useful for making plants with modified plant phenotypes as described in USSN 12/139,269
  misc_feature (1)..(180): Ceres CLONE ID no. 675195
  misc_feature (1)..(180): Utility: Useful for delaying flowering time
  misc_feature (1)..(180): Utility: Useful for increasing chlorophyll and photosynthetic capacity
  misc_feature (1)..(180): Utility: Useful for making ornamental plants with modified leaves
  misc_feature (1)..(180): Utility: Useful for making plants sterile and for genetic confinement
  misc_feature (1)..(180): Utility: Useful for making plants with increased biomass and foliage
  misc_feature (1)..(180): Utility: Useful for making smaller plants
MLRSTILIEPSLLRSLNFNSNKHHIASLNQWSCRFHSPKPPYSSSQNETPLSQDPVLKAISEISKGEGRVGQTTNVIIGSTAADDSNNEWLALDQKVNSYPTDRGFTAIGTGGEDFVQAMVVAVESVIQQPIPQGYVKQKLSSGGKYVSVNIGPIQVVSSEQVQAVYNAMRTDNRVKYFL

SEQ ID NO: 5807 - protein, 182 aa, Zea mays
  misc_feature (1)..(182): useful for making plants with modified plant phenotypes as described in USSN 12/139,269
  misc_feature (1)..(182): Ceres CLONE ID no. 460412
  misc_feature (1)..(182): Utility: Useful for delaying flowering time
  misc_feature (1)..(182): Utility: Useful for increasing chlorophyll and photosynthetic capacity
  misc_feature (1)..(182): Utility: Useful for making ornamental plants with modified leaves
  misc_feature (1)..(182): Utility: Useful for making plants sterile and for genetic confinement
  misc_feature (1)..(182): Utility: Useful for making plants with increased biomass and foliage
  misc_feature (1)..(182): Utility: Useful for making smaller plants
MACRALALRSLLLPDPLHRLPAAAPPVWRASRGGRRPHLRCCSGGGGGEPGQPPQEAVLEAISKIARSKGRVALTTNMVMGGTVTDDASDEWLVLDQKVNSYPTDRGFTAIGTGGDDFVQSMVVAVESVLQESIPKGRVSQKLSSRGKYVSVNIGPIRVVSSEQVQAVYRAMRRDNRMKYFL

SEQ ID NO: 5808 - protein, 186 aa, Zea mays
  misc_feature (1)..(186): useful for making plants with modified plant phenotypes as described in USSN 12/139,269
  misc_feature (1)..(186): Public GI no. 50908821
  misc_feature (1)..(186): Utility: Useful for delaying flowering time
  misc_feature (1)..(186): Utility: Useful for increasing chlorophyll and photosynthetic capacity
  misc_feature (1)..(186): Utility: Useful for making ornamental plants with modified leaves
  misc_feature (1)..(186): Utility: Useful for making plants sterile and for genetic confinement
  misc_feature (1)..(186): Utility: Useful for making plants with increased biomass and foliage
  misc_feature (1)..(186): Utility: Useful for making smaller plants
MMACRALALLPLPAPSRLPRPRAASLARLDAARRRASASLLVRCCANPAGPGGQEDPPQDAVLKAISQVANSKGRVAQTTNVVMGGTVTDDATDEWLVLDKQVNTYPTVRGFTAIGTGGDDFVQAMVVAVESVLEEQIPKAQISHKVSSKGKYVSVKIGPIPVVSSEQVQAVYNAMKKDERMKFFL

SEQ ID NO: 5809 - DNA, 1139 bp, Arabidopsis thaliana
  misc_feature (1)..(1139): useful for making plants with modified plant phenotypes as described in USSN 12/139,269
  misc_feature (1)..(1139): Ceres CLONE ID no. 40508
  misc_feature (1)..(1139): Also known as  Ceres CDNA ID no. 23356656
agaaaccgatagacctctctcattcgatcatttcttcttcttcttcgtcttcgctgcagcctgcatctgttgtttcttctagactttgcagtcacagagatagtgagtgagatagagagagtgataatggcgagtggactaagcgagatcgggagcacgaagatgttcgatggctacaacaaaagatacaaacacttcagtgagacacttggatgttccatgaccttttccatctacttccctccttctgcttctgcttcttcttcccataaatctcctgtgctttactggctttctggcctcacctgcacggacgagaacttcattatcaaatcaggagctcaacgtgctgcttctactcacggcattgctcttgttgctccagacacttctccaagaggactaaatgttgaaggggaggcagacagttacgactttggtgtaggagccggattctacctcaatgctactcaggaaaagtggaagaactggcgtatgtatgactatgttgtcaaagagttgccaaaactcctgagtgaaaacttttcccagcttgacacaacaaaagcatctatatctggacactccatgggtggacatggagctcttactatatacctgaggaacctcgataaatacaagtctgtatctgcgtttgcaccaatcacgaatcccataaattgtgcatggggacagaaggcattcaccaattatctaggtgacaacaaagctgcttgggaggaatacgatgccacttgtcttatttcaaagtacaacaatctttctgcaacaattctaattgatcagggagaaaacgaccagttctaccctgatcagttattgcccagcaagtttgaggaggcgtgcaagaaagtgaatgcaccgctcttattgcgcctccatccaggatacgaccactcctactatttcattgccaccttcatcgaagaccacattagtcaccatgctcaagcccttgagctatagctcacttcatctgcttggaaaccggctttgggtttgtccaagtattagtatctcaataaagcaagtggacttgtaatgttttatgttcaataactcccctgtgtgctcttttgtctacgataataataagaaaatcatctttgcttcatacc

SEQ ID NO: 5810 - protein, 286 aa, Arabidopsis thaliana
  misc_feature (1)..(286): useful for making plants with modified plant phenotypes as described in USSN 12/139,269
  misc_feature (19)..(279): Pfam Name: Esterase; Pfam Description: Putative esterase
  misc_feature (74)..(280): Pfam Name: Peptidase_S9; Pfam Description: Prolyl oligopeptidase family
  misc_feature (1)..(286): Utility: Useful for delaying flowering time
  misc_feature (1)..(286): Utility: Useful for increasing chlorophyll and photosynthetic capacity
  misc_feature (1)..(286): Utility: Useful for making ornamental plants with modified leaves
  misc_feature (1)..(286): Utility: Useful for making plants with altered leaf shape eg curled leaves
  misc_feature (1)..(286): Utility: Useful for making plants with increased biomass
  misc_feature (1)..(286): Utility: Useful for making plants with increased biomass and foliage
  misc_feature (1)..(286): Utility: Useful for making shorter plants and plants with modified flowers
  misc_feature (1)..(286): Utility: Useful for making smaller plants
MASGLSEIGSTKMFDGYNKRYKHFSETLGCSMTFSIYFPPSASASSSHKSPVLYWLSGLTCTDENFIIKSGAQRAASTHGIALVAPDTSPRGLNVEGEADSYDFGVGAGFYLNATQEKWKNWRMYDYVVKELPKLLSENFSQLDTTKASISGHSMGGHGALTIYLRNLDKYKSVSAFAPITNPINCAWGQKAFTNYLGDNKAAWEEYDATCLISKYNNLSATILIDQGENDQFYPDQLLPSKFEEACKKVNAPLLLRLHPGYDHSYYFIATFIEDHISHHAQALEL

SEQ ID NO: 5811 - protein, 281 aa, Glycine max
  misc_feature (1)..(281): useful for making plants with modified plant phenotypes as described in USSN 12/139,269
  misc_feature (1)..(281): Ceres CLONE ID no. 1063112
  misc_feature (1)..(281): Utility: Useful for delaying flowering time
  misc_feature (1)..(281): Utility: Useful for increasing chlorophyll and photosynthetic capacity
  misc_feature (1)..(281): Utility: Useful for making ornamental plants with modified leaves
  misc_feature (1)..(281): Utility: Useful for making plants with altered leaf shape eg curled leaves
  misc_feature (1)..(281): Utility: Useful for making plants with increased biomass
  misc_feature (1)..(281): Utility: Useful for making plants with increased biomass and foliage
  misc_feature (1)..(281): Utility: Useful for making shorter plants and plants with modified flowers
  misc_feature (1)..(281): Utility: Useful for making smaller plants
MENGLSEIGSTKMFDGYNKRYKHNSETLGCSMTFSIYFPPSSHRSPVLYWLSGLTCTDENFIIKSGAQRAASTHGIALVVPDTSPRGLNIEGEADSYDFGVGAGFYLNATQEKWKNWRMYDYVVKELPKLLSENFPQLDTTRASISGHSMGGHGALTIYLKNLDKYKSVSAFAPIANPINCPWGQKAFTNYLGDNKAAWEEYDATCLISKFNNLSATILIDQGENDQFYPDQLLPNKFEEACKKVNAPLLVRLQPGYDHSYYFIATFIEDHISHHVQALEL

SEQ ID NO: 5812 - protein, 273 aa, Glycine max
  misc_feature (1)..(273): useful for making plants with modified plant phenotypes as described in USSN 12/139,269
  misc_feature (1)..(273): Ceres CLONE ID no. 521881
  misc_feature (1)..(273): Utility: Useful for delaying flowering time
  misc_feature (1)..(273): Utility: Useful for increasing chlorophyll and photosynthetic capacity
  misc_feature (1)..(273): Utility: Useful for making ornamental plants with modified leaves
  misc_feature (1)..(273): Utility: Useful for making plants with altered leaf shape eg curled leaves
  misc_feature (1)..(273): Utility: Useful for making plants with increased biomass
  misc_feature (1)..(273): Utility: Useful for making plants with increased biomass and foliage
  misc_feature (1)..(273): Utility: Useful for making shorter plants and plants with modified flowers
  misc_feature (1)..(273): Utility: Useful for making smaller plants
MFGGYNKRFKHFSLTLGCSMNFHIYFPPSPSPSHKFPVLYFLSGLTCTDENFIFKSGAQRAASAEGVALVAPDTSPRGLNVEGEADSWDLGVGAGFYLNATQEKWKNWRMYDYVVKELPKLLSDNFPQLEISKASIFGHSMGGHGALTIFLKNQDKYKSVSAFAPIANPINCPWGQKAFSNYLGDNKSEWEDYDATRLVTKFPNVSSTILIDQGEDDKFLPDQLLPHKFEEACKKANVPLLLRFQPGYDHLYYFIATFIDDHIRHHAQALRLN

SEQ ID NO: 5813 - protein, 272 aa, Zea mays
  misc_feature (1)..(272): useful for making plants with modified plant phenotypes as described in USSN 12/139,269
  misc_feature (1)..(272): Ceres CLONE ID no. 217396
  misc_feature (1)..(272): Utility: Useful for delaying flowering time
  misc_feature (1)..(272): Utility: Useful for increasing chlorophyll and photosynthetic capacity
  misc_feature (1)..(272): Utility: Useful for making ornamental plants with modified leaves
  misc_feature (1)..(272): Utility: Useful for making plants with altered leaf shape eg curled leaves
  misc_feature (1)..(272): Utility: Useful for making plants with increased biomass
  misc_feature (1)..(272): Utility: Useful for making plants with increased biomass and foliage
  misc_feature (1)..(272): Utility: Useful for making shorter plants and plants with modified flowers
  misc_feature (1)..(272): Utility: Useful for making smaller plants
MFDGFNLRFRHQSATLGCAMTFSIYLPPSPASNLPVLYWLSGLTCTDENFIIKSGAQRAAAAHGIALVAPDTSPRGLNIEGESDSYDFGVGAGFYLNATNEKWKNWRMYDYIVKELPKVLSDNFEQLNTSQASIFGHSMGGHGALTIYLKNTDKYKSVSAFAPIANPINCPWGQKAFSNYLGSTKSDWEEYDATCLIKKNSKVPTTILIDQGEADKFLAEQQLLPHKFEEACKAAGAALTLRMQPGYDHSYYFIATFVDDHIAHHAQFLKSA

SEQ ID NO: 5814 - protein, 290 aa, Triticum aestivum
  misc_feature (1)..(290): useful for making plants with modified plant phenotypes as described in USSN 12/139,269
  misc_feature (1)..(290): Ceres CLONE ID no. 699913
  misc_feature (1)..(290): Utility: Useful for delaying flowering time
  misc_feature (1)..(290): Utility: Useful for increasing chlorophyll and photosynthetic capacity
  misc_feature (1)..(290): Utility: Useful for making ornamental plants with modified leaves
  misc_feature (1)..(290): Utility: Useful for making plants with altered leaf shape eg curled leaves
  misc_feature (1)..(290): Utility: Useful for making plants with increased biomass
  misc_feature (1)..(290): Utility: Useful for making plants with increased biomass and foliage
  misc_feature (1)..(290): Utility: Useful for making shorter plants and plants with modified flowers
  misc_feature (1)..(290): Utility: Useful for making smaller plants
MAAAASPPAAALEQLSKTKMFGGHNLRFRHQSAALGCPMTFSLFLPASPASKLPVLYWLSGLTCTDENFIIKSGAQRAAAAHGVALVAPDTSPRGLNVEGEADSWDFGVGAGFYLNATNEKWKNWRMYDYVVKELPKVLSDNFEQLNTSCASIFGHSMGGHGALTIYLKNTDKYKSVSAFAPIANPINCPWGQKAFSNYLGTTKSEWEEYDATLLVKKCNTLSTPILVDQGEDDKFLAEQLLAGNFEEACKAAGAPLTLRMQPGYDHSFFFIATFIDDHIAHHAQFLKSG

SEQ ID NO: 5815 - protein, 292 aa, Triticum aestivum
  misc_feature (1)..(292): useful for making plants with modified plant phenotypes as described in USSN 12/139,269
  misc_feature (1)..(292): Public GI no. 57900400
  misc_feature (1)..(292): Utility: Useful for delaying flowering time
  misc_feature (1)..(292): Utility: Useful for increasing chlorophyll and photosynthetic capacity
  misc_feature (1)..(292): Utility: Useful for making ornamental plants with modified leaves
  misc_feature (1)..(292): Utility: Useful for making plants with altered leaf shape eg curled leaves
  misc_feature (1)..(292): Utility: Useful for making plants with increased biomass
  misc_feature (1)..(292): Utility: Useful for making plants with increased biomass and foliage
  misc_feature (1)..(292): Utility: Useful for making shorter plants and plants with modified flowers
  misc_feature (1)..(292): Utility: Useful for making smaller plants
MAAAAPSPPPVAALEQMSRTKMFGGHNLRFRHHSATLGCPMTFSVFLPPSPASDLPVLYWLSGLTCNDENFVTKAGAQRAAAAHGIALVAPDTSPRGLNIEGEADSWDFGVGAGFYLNATNEKWKNWRMYDYVVKELPKVLSDNFEQLNTSRASIFGHSMGGHGALTIYLKNTDKYKSVSAFSPVVNPINCPWGQKAFSNYLGPAKSDWKEYDATCLIKKCNKISTPILIDQGEDDKFLAKQLLPRNFEEACKAVGAPLTLRMQPGYDHSYFFIATFIDDHIAHHSQFLKSA

SEQ ID NO: 5816 - DNA, 1098 bp, Arabidopsis thaliana
  misc_feature (1)..(1098): useful for making plants with modified plant phenotypes as described in USSN 12/139,269
  misc_feature (1)..(1098): Ceres CLONE ID no. 40729
  misc_feature (1)..(1098): Also known as  Ceres CDNA ID no. 23360311
agagagctttctttagtgatggcggcgcttatccggtgttgctcctccttctctcatacttccggtggccaaccaccgccgcgtgacaagtctcgagctccagagattggaaaatttgctacatctattggctactcagtagtcagaaaacctggggatcatcctcctttctccaaaattatacattcgtcttcacagcctaaggagcgacaaggaaagggaatcttacaaacgccatttgccagtgtgggatctcttgacaagttttcagcttttgagggaattgggaggctcaaattaccggtgatggcagtgttgttgacaaactcccttcagatggctacacctcttgaagctttggctgctgagatatgtgagcctgagagctccatgttcagcatgcctattttgttgcttgttgctcttattggagccaccgttggagggttgcttgctcggcagaggaaaggggagttacagaggttgaatgaacaactacgacagattaacgcagctcttaggagacaagccaaaatcgagtcttatgcaccaagcttgagttatgctccagtgggagcaagaatcccagatagtgaaatcattgtggaaccaaagaaacaagagttgatttccaagttgaaaacaggaaaaacctttcttaggaaccaagaaccagagaaagcttatacagagttcaagatagctttggaacttgcccagagtctcaaagaccccaccgaagaaaagaaggctgcaagaggcctaggcgcctcgctgcagcgccaagggaagtatagggaagccatacagtatcactccatggttctagccatctcaaagagggaaagtgaagattctggaatcactgaagcatatggagctattgcagactgttataccgagctgggagatctcgagaaagctggaaagttctatgatacgtacattgctcggttagagactgactgatccttccgcaatgtttttttctttgttgtctgtttatgatcatgtaaaatcacatagaatggatatccaaatcccttttattgaatgtaattcgcttgtcttacaatccatgggaatacataactaatc

SEQ ID NO: 5817 - protein, 316 aa, Arabidopsis thaliana
  misc_feature (1)..(316): useful for making plants with modified plant phenotypes as described in USSN 12/139,269
  misc_feature (243)..(276): Pfam Name: TPR_1; Pfam Description: Tetratricopeptide repeat
  misc_feature (283)..(316): Pfam Name: TPR_2; Pfam Description: Tetratricopeptide repeat
  misc_feature (243)..(276): Pfam Name: TPR_1; Pfam Description: Tetratricopeptide repeat
  misc_feature (283)..(316): Pfam Name: TPR_2; Pfam Description: Tetratricopeptide repeat
  misc_feature (1)..(316): Utility: Useful for delaying flowering time
  misc_feature (1)..(316): Utility: Useful for delaying senescence
  misc_feature (1)..(316): Utility: Useful for increasing chlorophyll and photosynthetic capacity
  misc_feature (1)..(316): Utility: Useful for increasing seed/fruit yield or modifying fruit content
  misc_feature (1)..(316): Utility: Useful for making ornamental plants with modified flowers
  misc_feature (1)..(316): Utility: Useful for making ornamental plants with modified leaves
  misc_feature (1)..(316): Utility: Useful for making plants sterile and for genetic confinement
  misc_feature (1)..(316): Utility: Useful for making plants with increased biomass and foliage
  misc_feature (1)..(316): Utility: Useful for making shorter plants and plants with modified flowers
  misc_feature (1)..(316): Utility: Useful for making smaller plants
  misc_feature (1)..(316): Utility: Useful for making stronger plants
  misc_feature (1)..(316): Utility: Useful for modifying plant structure, ie increased branching
MAALIRCCSSFSHTSGGQPPPRDKSRAPEIGKFATSIGYSVVRKPGDHPPFSKIIHSSSQPKERQGKGILQTPFASVGSLDKFSAFEGIGRLKLPVMAVLLTNSLQMATPLEALAAEICEPESSMFSMPILLLVALIGATVGGLLARQRKGELQRLNEQLRQINAALRRQAKIESYAPSLSYAPVGARIPDSEIIVEPKKQELISKLKTGKTFLRNQEPEKAYTEFKIALELAQSLKDPTEEKKAARGLGASLQRQGKYREAIQYHSMVLAISKRESEDSGITEAYGAIADCYTELGDLEKAGKFYDTYIARLETD

SEQ ID NO: 5818 - protein, 126 aa, Parthenium argentatum
  misc_feature (1)..(126): useful for making plants with modified plant phenotypes as described in USSN 12/139,269
  misc_feature (1)..(126): Ceres CLONE ID no. 1604687
  misc_feature (1)..(126): Utility: Useful for delaying flowering time
  misc_feature (1)..(126): Utility: Useful for delaying senescence
  misc_feature (1)..(126): Utility: Useful for increasing chlorophyll and photosynthetic capacity
  misc_feature (1)..(126): Utility: Useful for increasing seed/fruit yield or modifying fruit content
  misc_feature (1)..(126): Utility: Useful for making ornamental plants with modified flowers
  misc_feature (1)..(126): Utility: Useful for making ornamental plants with modified leaves
  misc_feature (1)..(126): Utility: Useful for making plants sterile and for genetic confinement
  misc_feature (1)..(126): Utility: Useful for making plants with increased biomass and foliage
  misc_feature (1)..(126): Utility: Useful for making shorter plants and plants with modified flowers
  misc_feature (1)..(126): Utility: Useful for making smaller plants
  misc_feature (1)..(126): Utility: Useful for making stronger plants
  misc_feature (1)..(126): Utility: Useful for modifying plant structure, ie increased branching
MGFVRALPVGSIIANALLLATPLEALAEACEAEQSIFNMNMPLLLLVALIGATVGGLLARQRKAELQRLNEQLRQINVALKRQAKIESYAPALSYAPAAARVPDSEVIVDPKKQELISRLKKWGKL

SEQ ID NO: 5819 - protein, 297 aa, Glycine max
  misc_feature (1)..(297): useful for making plants with modified plant phenotypes as described in USSN 12/139,269
  misc_feature (1)..(297): Ceres CLONE ID no. 627169
  misc_feature (1)..(297): Utility: Useful for delaying flowering time
  misc_feature (1)..(297): Utility: Useful for delaying senescence
  misc_feature (1)..(297): Utility: Useful for increasing chlorophyll and photosynthetic capacity
  misc_feature (1)..(297): Utility: Useful for increasing seed/fruit yield or modifying fruit content
  misc_feature (1)..(297): Utility: Useful for making ornamental plants with modified flowers
  misc_feature (1)..(297): Utility: Useful for making ornamental plants with modified leaves
  misc_feature (1)..(297): Utility: Useful for making plants sterile and for genetic confinement
  misc_feature (1)..(297): Utility: Useful for making plants with increased biomass and foliage
  misc_feature (1)..(297): Utility: Useful for making shorter plants and plants with modified flowers
  misc_feature (1)..(297): Utility: Useful for making smaller plants
  misc_feature (1)..(297): Utility: Useful for making stronger plants
  misc_feature (1)..(297): Utility: Useful for modifying plant structure, ie increased branching
MVMLIRCSCFFARPRFSQPQFYGNNTKPLLPGKLAFLSLKPDKGVPHFEDTLDGSSKISCLLHCSKCKEDIHQRFPSLIFVASNVLMFSMPNTALAETCEADNSVFNMPILLAVALIGATVGGLLARQRRNELQRVNEQLIQINAALRKQAKIESYAPSLSYAPIGGGRILDNEIIVDPKKQELISKLKNGKNFLRNQQPDKAFTEFKNALELAQNLKDPIEEKKAARGLGASLQRQGKYRDAIKYHSMVLGISEREEEDSGSTEAFGAIADCYTELGELEKAGQFYDKYIARLEKD

SEQ ID NO: 5820 - protein, 324 aa, Oryza sativa
  misc_feature (1)..(324): useful for making plants with modified plant phenotypes as described in USSN 12/139,269
  misc_feature (1)..(324): Public GI no. 34914598
  misc_feature (1)..(324): Utility: Useful for delaying flowering time
  misc_feature (1)..(324): Utility: Useful for delaying senescence
  misc_feature (1)..(324): Utility: Useful for increasing chlorophyll and photosynthetic capacity
  misc_feature (1)..(324): Utility: Useful for increasing seed/fruit yield or modifying fruit content
  misc_feature (1)..(324): Utility: Useful for making ornamental plants with modified flowers
  misc_feature (1)..(324): Utility: Useful for making ornamental plants with modified leaves
  misc_feature (1)..(324): Utility: Useful for making plants sterile and for genetic confinement
  misc_feature (1)..(324): Utility: Useful for making plants with increased biomass and foliage
  misc_feature (1)..(324): Utility: Useful for making shorter plants and plants with modified flowers
  misc_feature (1)..(324): Utility: Useful for making smaller plants
  misc_feature (1)..(324): Utility: Useful for making stronger plants
  misc_feature (1)..(324): Utility: Useful for modifying plant structure, ie increased branching
MELLLRPSPPPPWAIPRRSSGERTKPCRSRSRSRTGTSKQTFPVPLLVGKVGRRPFPVQCSIVRCCLSSTDAIHSTSDDIHEDNGHGHFLMKSTSDLQKVISSCFGKACLLSSVMLVLPPSCFAEPCEPEYSLPNMPLLFAIAMIGATVGGLLARQRRGELKRLNDQLRQINAALRRQAKIESYAPSLSYAPVGSKIPESEVIVDPQKDRLISYLRAGKNYLRNQAPDKAFPEFKAAFDLAQSLGDHVEEKKAARGLGASLQRQGKYKEAIKYHSMVLNISKLTGEDAGVTEAYGAIADCYTELGELEKAGKFYDKYIARLEND

SEQ ID NO: 5821 - protein, 319 aa, Zea mays
  misc_feature (1)..(319): useful for making plants with modified plant phenotypes as described in USSN 12/139,269
  misc_feature (1)..(319): Ceres CLONE ID no. 1397168
  misc_feature (1)..(319): Utility: Useful for delaying flowering time
  misc_feature (1)..(319): Utility: Useful for delaying senescence
  misc_feature (1)..(319): Utility: Useful for increasing chlorophyll and photosynthetic capacity
  misc_feature (1)..(319): Utility: Useful for increasing seed/fruit yield or modifying fruit content
  misc_feature (1)..(319): Utility: Useful for making ornamental plants with modified flowers
  misc_feature (1)..(319): Utility: Useful for making ornamental plants with modified leaves
  misc_feature (1)..(319): Utility: Useful for making plants sterile and for genetic confinement
  misc_feature (1)..(319): Utility: Useful for making plants with increased biomass and foliage
  misc_feature (1)..(319): Utility: Useful for making shorter plants and plants with modified flowers
  misc_feature (1)..(319): Utility: Useful for making smaller plants
  misc_feature (1)..(319): Utility: Useful for making stronger plants
  misc_feature (1)..(319): Utility: Useful for modifying plant structure, ie increased branching
MALLLRLAAPSVPPRRSSGLRALPRVVLPEVVSKQSFLRLLVDSTASMPCPIKCSAARCAPSLTEHNDSRNNGIHASSVYGHDLMKSMSDLQEVVFSSFSKACLLSSCIIYGLPPSCIAEPCEQEYFLPNMPLLFAIAMVGATVGGLLARQRRGELARLNDQLRQINAALRRQAKIESYAPALSYAPVGSKIPESEVIVDPQKQRLIAYLRTGKNYLRNQAPDKAFPEFKAALDLARSLGDHVEEKKAARGLGASLQRQGKYKEAINYHSMVLNISKVTGEDAGVTEAYGAIADCYTELGELEKAGKFYDKYIARLENE

SEQ ID NO: 5822 - protein, 319 aa, Zea mays
  misc_feature (1)..(319): useful for making plants with modified plant phenotypes as described in USSN 12/139,269
  misc_feature (1)..(319): Public GI no. 50909895
  misc_feature (1)..(319): Utility: Useful for delaying flowering time
  misc_feature (1)..(319): Utility: Useful for delaying senescence
  misc_feature (1)..(319): Utility: Useful for increasing chlorophyll and photosynthetic capacity
  misc_feature (1)..(319): Utility: Useful for increasing seed/fruit yield or modifying fruit content
  misc_feature (1)..(319): Utility: Useful for making ornamental plants with modified flowers
  misc_feature (1)..(319): Utility: Useful for making ornamental plants with modified leaves
  misc_feature (1)..(319): Utility: Useful for making plants sterile and for genetic confinement
  misc_feature (1)..(319): Utility: Useful for making plants with increased biomass and foliage
  misc_feature (1)..(319): Utility: Useful for making shorter plants and plants with modified flowers
  misc_feature (1)..(319): Utility: Useful for making smaller plants
  misc_feature (1)..(319): Utility: Useful for making stronger plants
  misc_feature (1)..(319): Utility: Useful for modifying plant structure, ie increased branching
MPARAAALSCRGVSPHPRAHSLLPGRRRRPVLPFADEAAAAPLRVSSVPHSRAYGCGGGGYFVHLEDRDDGEASRLLRALRRVLPDHQKWAQPDLLKAAVISTMSILAVPLEASASAETCQPANSMANMPIFIAVALIGAAVGGLLARQRKEELKRLNTQLRQINTALRRQAQIESFAPGLTYAPVGRATETEVIVDPRKQQLTVNLRNGKTFMRNQDLDMAVKEFRAALELAKSVGDRFEEKKAARGLGASLQRLGKYREAMNCYYKVLELSKETGEDSGCTEAYGAIADCYTELGDLERAAKLYDKYISRLQPGGGE

SEQ ID NO: 5823 - protein, 202 aa, Zea mays
  misc_feature (1)..(202): useful for making plants with modified plant phenotypes as described in USSN 12/139,269
  misc_feature (1)..(202): Ceres CLONE ID no. 304724
  misc_feature (1)..(202): Utility: Useful for delaying flowering time
  misc_feature (1)..(202): Utility: Useful for delaying senescence
  misc_feature (1)..(202): Utility: Useful for increasing chlorophyll and photosynthetic capacity
  misc_feature (1)..(202): Utility: Useful for increasing seed/fruit yield or modifying fruit content
  misc_feature (1)..(202): Utility: Useful for making ornamental plants with modified flowers
  misc_feature (1)..(202): Utility: Useful for making ornamental plants with modified leaves
  misc_feature (1)..(202): Utility: Useful for making plants sterile and for genetic confinement
  misc_feature (1)..(202): Utility: Useful for making plants with increased biomass and foliage
  misc_feature (1)..(202): Utility: Useful for making shorter plants and plants with modified flowers
  misc_feature (1)..(202): Utility: Useful for making smaller plants
  misc_feature (1)..(202): Utility: Useful for making stronger plants
  misc_feature (1)..(202): Utility: Useful for modifying plant structure, ie increased branching
MDGEAPRLPHALRRMLIDHQKMACPNLLKAAVLSTMTLLAVPLEASAEMCQPPSSFANMPIFIVVALIGAAVGGLLARQRKAELKRLNNQLRQINAALRRQAQIESFAPGLTYAPVGRTNETDVIVDPRKQQLVTNLRNGKNYMRNQDLDKAIVEFRTALELAESIGDRFEEKKAARGLEAREVPRSNETVQQGSGAVQGDR

SEQ ID NO: 5824 - DNA, 1473 bp, Arabidopsis thaliana
  misc_feature (1)..(1473): useful for making plants with modified plant phenotypes as described in USSN 12/139,269
  misc_feature (1)..(1473): Ceres CLONE ID no. 41306
  misc_feature (1)..(1473): Also known as  Ceres CDNA ID no. 23359586
agagattacaagagtgttgtttgagagcgaatcaaggttcctccaaagaaagaagatgactttaattcttatttaatttccctttctccttttgcttcaccaaaatccacacattcatcaattaaaaaacaaaccctagattcttgaaaactggaactcattcacgaatcctaaaaagagagctcctttggttttcttgaaacccagattcttcaagctcagctatggcggtcttcaaaaccctagctttcctattcgttttaagcatcgtgatttaccaatcagtggctgttacagatgtaaattcatcgttttcctttaatgggtttgtcaaagctccaagctttgacaataatgttgctctgtttggagattcgaagctcgttcatggcggtccatcgattcaattgactgactcagtgagtcgcagtgaagggcgagttatttacaagaaacccatcagactgttccaaggtaaagagagaaacttttccggatcattctcaactagtttctcgttttcgatgtctgatgagattggtagtgtcttggcttttataatggttccaagaggtttggatcttaggttgtttggtagaaagggtaataatagttcctctggtttagggttcttattgaaacacaaagttgttgctgttgagtttggtatctccaagagagggaatcatgtagggatcttagttggtcgtcctgaatctggtaaagttagaaagttatcatcttttggtcaccatttcaatgaagagaagagattgaattgttggattgattatgaggcaagctcaaagagaatagaggttcgtttgagtctatctgctgccttaaagccggtggatccattcgtgtcttactctgtagacttggctaagctatggaaagatgggaagtttatggtgggtttaacctctgcaaatggaaacacttcaaagccggtttatctccattcgtggagctttaaactgatacatccttcgatgaggattcactcgcagccgcttgatccaaacgacgtttccaagactgttaaggaaggggagaagacggtggaagttaaggggaaaggaaaatgtatatggagaatccttggtgcattggtcttgggggcggtttgtggaacattgggagccatgttcgcgttatacctttggacaatatgcggtaataggcagtcaatggcgatagttcccgaggaatgtgctgacgaaaaagcggatatccttgtaacgaaagctgatgttgttgttgaagaagaagtcaagaagtagtagaaaaagaaaagtttggtgtgtgtgttttagaatgttgtatttgttgtttgtaatgtaaattcttgtgtccttctttattcttcttctgtttgtttttttgttagttgcagatttggtgagatgagttttcacatgtagaagaaccatacaatatgtattaagttaagatcctgaaatcttgatc

SEQ ID NO: 5825 - protein, 353 aa, Arabidopsis thaliana
  misc_feature (1)..(353): useful for making plants with modified plant phenotypes as described in USSN 12/139,269
  misc_feature (23)..(204): Pfam Name: Lectin_legB; Pfam Description: Legume lectins beta domain
  misc_feature (1)..(353): Utility: Useful for delaying flowering time
  misc_feature (1)..(353): Utility: Useful for making smaller plants
  misc_feature (1)..(353): Utility: Useful for making stronger plants
MAVFKTLAFLFVLSIVIYQSVAVTDVNSSFSFNGFVKAPSFDNNVALFGDSKLVHGGPSIQLTDSVSRSEGRVIYKKPIRLFQGKERNFSGSFSTSFSFSMSDEIGSVLAFIMVPRGLDLRLFGRKGNNSSSGLGFLLKHKVVAVEFGISKRGNHVGILVGRPESGKVRKLSSFGHHFNEEKRLNCWIDYEASSKRIEVRLSLSAALKPVDPFVSYSVDLAKLWKDGKFMVGLTSANGNTSKPVYLHSWSFKLIHPSMRIHSQPLDPNDVSKTVKEGEKTVEVKGKGKCIWRILGALVLGAVCGTLGAMFALYLWTICGNRQSMAIVPEECADEKADILVTKADVVVEEEVKK

SEQ ID NO: 5826 - protein, 353 aa, Glycine max
  misc_feature (1)..(353): useful for making plants with modified plant phenotypes as described in USSN 12/139,269
  misc_feature (1)..(353): Ceres CLONE ID no. 578942
  misc_feature (1)..(353): Utility: Useful for delaying flowering time
  misc_feature (1)..(353): Utility: Useful for making smaller plants
  misc_feature (1)..(353): Utility: Useful for making stronger plants
MAPFSTSPHFTAFTFLILFLKTQAFDPLSFFSFTDFEKDPNFKSSVGLYGNAKVVNNGSEVLLSGNGGRVIYKKPVKLVHGGARELVSFSTYFGFSMSLDSEKSGLAFVMVPSGVEGEVFGNSSYGLSFGLKEREFKVVGVQFSAYGRNGGSGSCIVSINVGSSVPVKTINASSVIMGLKSEGKLHAWIDYEASSKRLEVRLNQYGQSRPVDPLLWHSMDLSNVWGTEEMFAGFSTVKENNTSQTCFLYSWSFIVRHFPHWMHSEPLNPKVLAKKTETPAVKSRSDCLLRVLAAMIFGAGCGALTAFIVLYLWTIFGNKRPVVPEEYAMQPVDFEYKKVSIVVDKTTIIDAKE

SEQ ID NO: 5827 - DNA, 1142 bp, Arabidopsis thaliana
  misc_feature (1)..(1142): useful for making plants with modified plant phenotypes as described in USSN 12/139,269
  misc_feature (1)..(1142): Ceres CLONE ID no. 41439
  misc_feature (1)..(1142): Also known as  Ceres CDNA ID no. 23374774
  misc_feature (505)..(505): s is g or c
  misc_feature (506)..(506): r is g or a
aagcacttcactctctaatttccttctctctatctctcaccatattcgcgattaaaaactctcaacttttctctcaaatttctgatcctttaatccaacagttagaagaagattcatctgatcatggccctcgaagcgatgaacactccaacttcttctttcaccagaatcgaaacgaaagaagatttgatgaacgacgccgttttcattgagccgtggcttaaacgcaaacgctccaaacgtcagcgttctcacagcccttcttcgtcttcttcctcaccgcctcgatctcgacccaaatcccagaatcaagatcttacggaagaagagtatctcgctctttgtctcctcatgctcgctaaagatcaaccgtcgcaaacgcgatttcatcaacagtcgcaatcgttaacgccgccgccagaatcaaagaaccttccgtacaagtgtaacgtctgtgaaaaagcgtttccttcctatcaggctttaggcggtcacaaagcaagtsrccgaatcaaaccaccaaccgtaatctcaacaactgccgatgattcaacagctccgaccatctccatcgtcgccggagaaaaacatccgattgctgcctccggaaagatccacgagtgttcaatctgtcataaagtgtttccgacgggtcaagctttaggcggtcacaaacgttgtcactacgaaggcaacctcggcggcggaggaggaggaggaagcaaatcaatcagtcacagtggaagcgtgtcgagcacggtatcggaagaaaggagccaccgtggattcatcgatctaaacctaccggcgttacctgaactcagccttcatcacaatccaatcgtcgacgaagagatcttgagtccgttgaccggtaaaaaaccgcttttgttgaccgatcacgaccaagtcatcaagaaagaagatttatctttaaaaatctaatactcgactattaattcttgtgttttcattttcatttttttagttacaaatttttaattgttctgatttggattgaatattggtatattgttagggattgatacaaaaatttgatgattgattaagtcagaatttctttttaattatggtaactaatctcttgatcagtccactctgtataaatattgcgtggcatt

SEQ ID NO: 5828 - protein, 273 aa, Arabidopsis thaliana
  misc_feature (1)..(273): useful for making plants with modified plant phenotypes as described in USSN 12/139,269
  misc_feature (106)..(128): Pfam Name: zf-C2H2; Pfam Description: Zinc finger, C2H2 type
  misc_feature (106)..(128): Pfam Name: zf-C2H2; Pfam Description: Zinc finger, C2H2 type
  misc_feature (1)..(273): Utility: Useful for delaying flowering time
  misc_feature (1)..(273): Utility: Useful for increasing chlorophyll and photosynthetic capacity
  misc_feature (1)..(273): Utility: Useful for making larger plants
  misc_feature (1)..(273): Utility: Useful for making plants with altered leaf shape eg curled leaves
  misc_feature (1)..(273): Utility: Useful for making plants with increased biomass and foliage
  misc_feature (1)..(273): Utility: Useful for making smaller plants
MALEAMNTPTSSFTRIETKEDLMNDAVFIEPWLKRKRSKRQRSHSPSSSSSSPPRSRPKSQNQDLTEEEYLALCLLMLAKDQPSQTRFHQQSQSLTPPPESKNLPYKCNVCEKAFPSYQALGGHKASHRIKPPTVISTTADDSTAPTISIVAGEKHPIAASGKIHECSICHKVFPTGQALGGHKRCHYEGNLGGGGGGGSKSISHSGSVSSTVSEERSHRGFIDLNLPALPELSLHHNPIVDEEILSPLTGKKPLLLTDHDQVIKKEDLSLKI

SEQ ID NO: 5829 - protein, 235 aa, Arabidopsis thaliana
  misc_feature (1)..(235): useful for making plants with modified plant phenotypes as described in USSN 12/139,269
  misc_feature (1)..(235): Public GI no. 7228329
  misc_feature (1)..(235): Utility: Useful for delaying flowering time
  misc_feature (1)..(235): Utility: Useful for increasing chlorophyll and photosynthetic capacity
  misc_feature (1)..(235): Utility: Useful for making larger plants
  misc_feature (1)..(235): Utility: Useful for making plants with altered leaf shape eg curled leaves
  misc_feature (1)..(235): Utility: Useful for making plants with increased biomass and foliage
  misc_feature (1)..(235): Utility: Useful for making smaller plants
MAMEALNSPTTATPFTPFEEPNLSYLETPWTKGKRSKRSRMDQSSCTEEEYLALCLIMLARSGNNNDKKSDSVATPLTTVKLSHKCSVCNKAFSSYQALGGHKASHRKAVMSATTAEDQITTTSSAVTTSSASNGKNKTHECSICHKSFPTGQALGGHKRCHYEGSVGAGAGAGSNAVTASEGVGLSHSHHRDFDLNLPAFPDFSKKFFVDDEVFSPLPAAKKPCLFKLEIPSHY

SEQ ID NO: 5830 - protein, 273 aa, Arabidopsis thaliana
  misc_feature (1)..(273): useful for making plants with modified plant phenotypes as described in USSN 12/139,269
  misc_feature (1)..(273): Public GI no. 2981169
  misc_feature (1)..(273): Utility: Useful for delaying flowering time
  misc_feature (1)..(273): Utility: Useful for increasing chlorophyll and photosynthetic capacity
  misc_feature (1)..(273): Utility: Useful for making larger plants
  misc_feature (1)..(273): Utility: Useful for making plants with altered leaf shape eg curled leaves
  misc_feature (1)..(273): Utility: Useful for making plants with increased biomass and foliage
  misc_feature (1)..(273): Utility: Useful for making smaller plants
MTLEALKSPTAATPTLPPRYEDDDEIHNLDSWAKGKRSKRPRIDAPPTEEEYLALCLIMLARSGTGTRTGLTDATTSQQPADKKTAELPPVHKKEVATEQAEQSYKCSVCDKAFSSYQALGGHKASHRKTTTTATAASDDNNPSTSTSTGAVNISALNPTGRSHVCSICHKAFPTGQALGGHKRRHYEGKLGGNSRDLGGGGGGGHSGSVLTTSDGGASTHTLRDFDLNMPASPELQLGLSIDCGRKSQLLPMVQEVESPMPAKKPRLLFSLG

SEQ ID NO: 5831 - protein, 259 aa, Arabidopsis thaliana
  misc_feature (1)..(259): useful for making plants with modified plant phenotypes as described in USSN 12/139,269
  misc_feature (1)..(259): Public GI no. 55734108
  misc_feature (1)..(259): Utility: Useful for delaying flowering time
  misc_feature (1)..(259): Utility: Useful for increasing chlorophyll and photosynthetic capacity
  misc_feature (1)..(259): Utility: Useful for making larger plants
  misc_feature (1)..(259): Utility: Useful for making plants with altered leaf shape eg curled leaves
  misc_feature (1)..(259): Utility: Useful for making plants with increased biomass and foliage
  misc_feature (1)..(259): Utility: Useful for making smaller plants
MALEALNSPTTPTPVFQYENAATLRYLDQPWAKGKRSKRPRSVEPPPPQHQQQQQPTEEEYLALCLIMLARGGAPSTTTLPLPPPPQQHNIPSSSSSDPPKLLYKCSVCDKAFSSYQALGGHKASHRKLSTASAGGGDDQSTTSTSTTTAAAATGRTHECSICHKCFPSGQALGGHKRCHYEGGAGAVGSTGNAASGVTSSEGMGSTNTHSNRDFDLNLPALPEFWLAAAAGDDEVSSPHPAKRSRFALPIKVENHQIN

SEQ ID NO: 5832 - protein, 253 aa, Arabidopsis thaliana
  misc_feature (1)..(253): useful for making plants with modified plant phenotypes as described in USSN 12/139,269
  misc_feature (1)..(253): Public GI no. 439493
  misc_feature (1)..(253): Utility: Useful for delaying flowering time
  misc_feature (1)..(253): Utility: Useful for increasing chlorophyll and photosynthetic capacity
  misc_feature (1)..(253): Utility: Useful for making larger plants
  misc_feature (1)..(253): Utility: Useful for making plants with altered leaf shape eg curled leaves
  misc_feature (1)..(253): Utility: Useful for making plants with increased biomass and foliage
  misc_feature (1)..(253): Utility: Useful for making smaller plants
MALEALNSPTTTTPPSFQFENNGLKYLESWTKGKRSKRQRSMERQCTEEEYLALCLIMLARSDGSVNNSRSLPPPPLPPSVPVTSQINATLLEQKNLYKCSVCGKGFGSYQALGGHKASHRKLVSMGGDEQSTTSTTTNVTGTSSANVNGNGRTHECSICHKCFPTGQALGGHKRCHYDGGNGNGNGSVSVGVTSSEGVGSTISHHRDFDLNIPALPEFWPGFGSGEDEVESPHPAKKSRLSLPPKLELFKGL

SEQ ID NO: 5833 - protein, 240 aa, Arabidopsis thaliana
  misc_feature (1)..(240): useful for making plants with modified plant phenotypes as described in USSN 12/139,269
  misc_feature (1)..(240): Public GI no. 7488707
  misc_feature (1)..(240): Utility: Useful for delaying flowering time
  misc_feature (1)..(240): Utility: Useful for increasing chlorophyll and photosynthetic capacity
  misc_feature (1)..(240): Utility: Useful for making larger plants
  misc_feature (1)..(240): Utility: Useful for making plants with altered leaf shape eg curled leaves
  misc_feature (1)..(240): Utility: Useful for making plants with increased biomass and foliage
  misc_feature (1)..(240): Utility: Useful for making smaller plants
MALEALNSPTTTAPSFPFDDPTIPWAKRKRSKRSRDHPSEEEYLALCLIMLARGGTTTVNNRHVSPPPLQPQPQPTPDPSTKLSYKCSVCDKSFPSYQALGGHKASHRKLAGAAEDQPPSTTTSSAAATSSASGGKAHECSICHKSFPTGQALGGHKRCHYEGNGNGNNNNSNSVVTVASEGVGSTHTVSHGHHRDFDLNIPAFPDFSTKVGEDEVESPHPVMKKPRLFVIPKIEIPQFQ

SEQ ID NO: 5834 - protein, 253 aa, Arabidopsis thaliana
  misc_feature (1)..(253): useful for making plants with modified plant phenotypes as described in USSN 12/139,269
  misc_feature (1)..(253): Public GI no. 33771374
  misc_feature (1)..(253): Utility: Useful for delaying flowering time
  misc_feature (1)..(253): Utility: Useful for increasing chlorophyll and photosynthetic capacity
  misc_feature (1)..(253): Utility: Useful for making larger plants
  misc_feature (1)..(253): Utility: Useful for making plants with altered leaf shape eg curled leaves
  misc_feature (1)..(253): Utility: Useful for making plants with increased biomass and foliage
  misc_feature (1)..(253): Utility: Useful for making smaller plants
MALEALNSPTTTTPPTFQFENNGPLRYLENWTKGKRSKRPRSMERQPTEEEYLALCLIMLARSDGSANREQSLPPPPVPVMKIHAPPEEKMVYKCSVCGKGFGSYQALGGHKASHRKLVAGGGGGDDQSTTSTTTNATGTTSSANGNGNGSGKTHECSICHKRFPTGQALGGHKRCHYDGGNSNGGVSVSASVGLTSSEGVGSTVSHRDFDLNIPALPEFWPGFGSGEDEVESPHPTKKSRLSLPPKFELFRE

SEQ ID NO: 5835 - protein, 239 aa, Triticum aestivum
  misc_feature (1)..(239): useful for making plants with modified plant phenotypes as described in USSN 12/139,269
  misc_feature (1)..(239): Ceres CLONE ID no. 701379
  misc_feature (1)..(239): Utility: Useful for delaying flowering time
  misc_feature (1)..(239): Utility: Useful for increasing chlorophyll and photosynthetic capacity
  misc_feature (1)..(239): Utility: Useful for making larger plants
  misc_feature (1)..(239): Utility: Useful for making plants with altered leaf shape eg curled leaves
  misc_feature (1)..(239): Utility: Useful for making plants with increased biomass and foliage
  misc_feature (1)..(239): Utility: Useful for making smaller plants
MAVEAVLEAATMIPSPPSKEMEASSSTSEEASALLGQAEGWSKRKRSRRQRALDPSEEEYLALCLLMLAHGHRDSAPAAAPEQQHGCSVCGKVFASYQALGGHKASHRKPTAAPAGAEDQKPLAAVAAASSSGSGEAAVSAGGGKVHECNVCRKTFPTGQALGGHKRCHYDGTIGSAAAGPTQKLAAKAAAASATAASQGFDLNLPALPDIPERCAVTEDGEEVLSPASFKKPRLMLAA

SEQ ID NO: 5836 - protein, 235 aa, Triticum aestivum
  misc_feature (1)..(235): useful for making plants with modified plant phenotypes as described in USSN 12/139,269
  misc_feature (1)..(235): Public GI no. 2058504
  misc_feature (1)..(235): Utility: Useful for delaying flowering time
  misc_feature (1)..(235): Utility: Useful for increasing chlorophyll and photosynthetic capacity
  misc_feature (1)..(235): Utility: Useful for making larger plants
  misc_feature (1)..(235): Utility: Useful for making plants with altered leaf shape eg curled leaves
  misc_feature (1)..(235): Utility: Useful for making plants with increased biomass and foliage
  misc_feature (1)..(235): Utility: Useful for making smaller plants
MALETLNSPTSATASARPLLRYREEMEPENLEQWAKRKRTKRQRFDQSRLNQETAPSEEEYLALCLLMLARGSAVQSPLPPSSSSDHRGYKCTVCGKSFSSYQALGGHKTSHRKPASNVNVPINQEQSNNSHSNSNGGSVVINGNGVSQSGKIHTCSICFKSFSSGQALGGHKRCHYDAGNNGNGNGSSSNSVEVVGGSDGSYVDDERSSEQSATGDNRGFDLNLPADQVAVVIS

SEQ ID NO: 5837 - protein, 233 aa, Glycine max
  misc_feature (1)..(233): useful for making plants with modified plant phenotypes as described in USSN 12/139,269
  misc_feature (1)..(233): Ceres CLONE ID no. 638614
  misc_feature (1)..(233): Utility: Useful for delaying flowering time
  misc_feature (1)..(233): Utility: Useful for increasing chlorophyll and photosynthetic capacity
  misc_feature (1)..(233): Utility: Useful for making larger plants
  misc_feature (1)..(233): Utility: Useful for making plants with altered leaf shape eg curled leaves
  misc_feature (1)..(233): Utility: Useful for making plants with increased biomass and foliage
  misc_feature (1)..(233): Utility: Useful for making smaller plants
MALETLNSPTTTAPSFPFDDPTIPWAKRKRSKRCSRDHPSEEEYLALCLIMLARGGTTRRVSTPPPQPTPDPSTKLSYKCSVCNKSFPSYQALGGHKASHRKLAASGGEDQPTTTSSAASSANTASGGRTHECSICHKSFPTGQALGGHKRCHYEGNSNGNNNNSNSSVTAASEGVGSTHTVSHGHHRDFDLNIPAFPDFSTKVGEDEVESPHPVMKKPRPFVIPKIEIPQYQ

SEQ ID NO: 5838 - protein, 261 aa, Glycine max
  misc_feature (1)..(261): useful for making plants with modified plant phenotypes as described in USSN 12/139,269
  misc_feature (1)..(261): Public GI no. 33331578
  misc_feature (1)..(261): Utility: Useful for delaying flowering time
  misc_feature (1)..(261): Utility: Useful for increasing chlorophyll and photosynthetic capacity
  misc_feature (1)..(261): Utility: Useful for making larger plants
  misc_feature (1)..(261): Utility: Useful for making plants with altered leaf shape eg curled leaves
  misc_feature (1)..(261): Utility: Useful for making plants with increased biomass and foliage
  misc_feature (1)..(261): Utility: Useful for making smaller plants
MALEALNSPTGTPTPPPFQFESDGQQLRYIENWRKGKRSKRSRSMEHQPTEEEYLALCLIMLARSGGSVNHQRSLPPPAPVMKLHAPSSSSAAEEEKEKMVYKCSVCGKGFGSYQALGGHKASHRKLVPGGDDQSTTSTTTNATGTTTSVNGNGNRSGRTHECSICHKCFPTGQALGGHKRCHYDGGIGNGNANSGVSASVGVTSSEGVGSTVSHRDFDLNIPALPEFWLGFGSGEDEVESPHPAKKSRLCLPPKYELFQH

SEQ ID NO: 5839 - protein, 247 aa, Glycine max
  misc_feature (1)..(247): useful for making plants with modified plant phenotypes as described in USSN 12/139,269
  misc_feature (1)..(247): Public GI no. 4666360
  misc_feature (1)..(247): Utility: Useful for delaying flowering time
  misc_feature (1)..(247): Utility: Useful for increasing chlorophyll and photosynthetic capacity
  misc_feature (1)..(247): Utility: Useful for making larger plants
  misc_feature (1)..(247): Utility: Useful for making plants with altered leaf shape eg curled leaves
  misc_feature (1)..(247): Utility: Useful for making plants with increased biomass and foliage
  misc_feature (1)..(247): Utility: Useful for making smaller plants
MALEALNSPTTATPVFHYDDPSLNYLEPWTKRKRSKRTRLDSPHTEEEYLAFCLIMLARGRVASANRRDSQSSIQIQPEATTSATKVSYKCSVCDKAFSSYQALGGHKASHRKLAGGEDQSTSFATTNSATVTTTTASGGGGRSHECSICHKSFPTGQALGGHKRCHYEGSIGGNSIHHHNNTTNSGSNGGMSMTSEVGSTHTVSHSHRDFDLNIPALPEFRSNFFISGDDEVESPHPAKKPRILMK

SEQ ID NO: 5840 - protein, 250 aa, Glycine max
  misc_feature (1)..(250): useful for making plants with modified plant phenotypes as described in USSN 12/139,269
  misc_feature (1)..(250): Public GI no. 28849865
  misc_feature (1)..(250): Utility: Useful for delaying flowering time
  misc_feature (1)..(250): Utility: Useful for increasing chlorophyll and photosynthetic capacity
  misc_feature (1)..(250): Utility: Useful for making larger plants
  misc_feature (1)..(250): Utility: Useful for making plants with altered leaf shape eg curled leaves
  misc_feature (1)..(250): Utility: Useful for making plants with increased biomass and foliage
  misc_feature (1)..(250): Utility: Useful for making smaller plants
MAVEAVLEASRSSSEEEAEVIVTHGGGGGGGGGGGQVEGWGKRKRSRRRRPQLPPSEEEYLALCLLMLARGRRDGDDVAASASAAAAAVEHRCSVCGKAFASYQALGGHKASHRKPPPPPPPAMVDDDEVVVETKPAAIATPSSSASGVSGGGGGRAHECNVCGKAFPTGQALGGHKRCHYDGTIGSAAGAGASKPAAKTTVAVAASRGFDLNLPALPDVAAAADQRCAAEDDEVLSPLAFKKPRLMIPA

SEQ ID NO: 5841 - protein, 237 aa, Glycine max
  misc_feature (1)..(237): useful for making plants with modified plant phenotypes as described in USSN 12/139,269
  misc_feature (1)..(237): Public GI no. 2058506
  misc_feature (1)..(237): Utility: Useful for delaying flowering time
  misc_feature (1)..(237): Utility: Useful for increasing chlorophyll and photosynthetic capacity
  misc_feature (1)..(237): Utility: Useful for making larger plants
  misc_feature (1)..(237): Utility: Useful for making plants with altered leaf shape eg curled leaves
  misc_feature (1)..(237): Utility: Useful for making plants with increased biomass and foliage
  misc_feature (1)..(237): Utility: Useful for making smaller plants
MALETLNSPTSATASARPLLRYREEMEPENLEQWAKRKRTKRQRFDQSRLNQETAPSEEEYLALCLLMLARGSAVQSPLPPSSSSDHRGYKCTVCGKSFSSYQALGGHKTSHRKPASNVNVPINQEQSNNSHSNSNGGSVAINGNGVSQSGKIHTCSICFKSFSSGQALGGHKRCHYDAGINGNGNGSSSNSVEVVGGSDGNYVDDERSSEQSATGDNRGFDLNLPADQVAVVISKR

SEQ ID NO: 5842 - DNA, 1809 bp, Arabidopsis thaliana
  misc_feature (1)..(1809): useful for making plants with modified plant phenotypes as described in USSN 12/139,269
  misc_feature (1)..(1809): Ceres CLONE ID no. 42141
  misc_feature (1)..(1809): Also known as  Ceres CDNA ID no. 23375607
  misc_feature (812)..(812): r is g or a
acgaaaaacaagtgatggaggaagtagtagtagtagttgcagacccaccaccgaagattactaccgttgtggaatacgaagaagagcttgaagatgatgacgatgatctctcgctttcgtcagattccgatatcgctgaagctcttgattggctagacggtaaagacgatgacgagctaattggtggtggcttctctcttcatgctcgtcgtcctaatgctcacggtggacatggttcacgccctaactctagtgctctacagcctatttccaataaggcccagaagcttactagtcacgttcgtgcttctcctttagagggatgggaaggaagagttaaagttgggatgtcgaattctgtgacaactgcgattcgtggaagtcttagagatacagaaattgggagaagtaggaatactgataaagcggaccgggcaactgttgaacaggctcttgatccaaggacgcgtatggtattgtttagaatgcttaataggggtgtgtttaacgatgttaatggctgtatttcgacaggcaaagaagcaaatgtttatcatgccacaaaatctgacggttcggaacttgcaataaaagtgtacaagacatctgttctggttttcaaggatcgagatcgatatgtacaaggagattaccgttttagatatggctactgtcgtcacaatcctcgaaagatggtgaagacatgggctgaaaaagaacagagaaatctcaagaggcttcatgcagcaggaattaggtgtccagctgttatacttctacgccttcatgttctagtcatggagtttataggragggatggttgggctgcaccgcgtctcaaggatgccgcattgtctctggacaagttgcgcgagtgttacttagagttgataattcaaatgcgagtattatatcagaagtgcaaattagtgcatggggatctcagtgagtataacatactttattttgaagggcacctttatataattgatgtttctcaatctgtggatctggaccatcctcttgcactcaactttctacgggaagattgtgaccatgtctcggattttttcaaaaaacatggtgtggctgttatgacaatacgagagctatttgacttcatagttgacccgacaatttcagacgaaaatgttgatagctatttggaagaggtccaacggaaagttatagagcgaggagagatatccgtagaggatgaaatcgcggattctgtattcatgaagtcatacataccgaaatctctggatgctgtgaacaacccagaggctgatgtagcgaagataacaagcgggcaggacacaggagacatgctgtaccaaacgataacggggcttaaggatgctcttcctaaagtagacgagcagcaaatagaggtgaatgctgaagaggaagaagaagaagaggaagagggaagtggagaagaaagcgaagaagagagtgaagaagaattgggtcctgaagacaagaaagctgcaaggaaagagcacaagaagaaagtgaaagaggagaaacgagagtctaggaagacgaaaacacccaaatctgtcaagaagcgaaaaaagaaagtctctaaaccccacaagactcgttagcatcttttgacacccatacttgtatcttttactatggacccgaaggctcttttgggtctctttatccaaaacagtaagttcttgtaatattcacagtacgattatgatagatcacatgataggtttgctggtgttttgagaggactaaaataatttttgttacttgacaattcgactaatggtagtctctaaattt

SEQ ID NO: 5843 - protein, 532 aa, Arabidopsis thaliana
  misc_feature (1)..(532): useful for making plants with modified plant phenotypes as described in USSN 12/139,269
  misc_feature (178)..(366): Pfam Name: RIO1; Pfam Description: RIO1 family
  misc_feature (178)..(366): Pfam Name: RIO1; Pfam Description: RIO1 family
  misc_feature (1)..(532): Utility: Useful for delaying flowering time
  misc_feature (1)..(532): Utility: Useful for making ornamental plants with modified leaves
  misc_feature (1)..(532): Utility: Useful for making plants with increased biomass and foliage
  misc_feature (1)..(532): Utility: Useful for making smaller plants
MEEVVVVVADPPPKITTVVEYEEELEDDDDDLSLSSDSDIAEALDWLDGKDDDELIGGGFSLHARRPNAHGGHGSRPNSSALQPISNKAQKLTSHVRASPLEGWEGRVKVGMSNSVTTAIRGSLRDTEIGRSRNTDKADRATVEQALDPRTRMVLFRMLNRGVFNDVNGCISTGKEANVYHATKSDGSELAIKVYKTSVLVFKDRDRYVQGDYRFRYGYCRHNPRKMVKTWAEKEQRNLKRLHAAGIRCPAVILLRLHVLVMEFIGRDGWAAPRLKDAALSLDKLRECYLELIIQMRVLYQKCKLVHGDLSEYNILYFEGHLYIIDVSQSVDLDHPLALNFLREDCDHVSDFFKKHGVAVMTIRELFDFIVDPTISDENVDSYLEEVQRKVIERGEISVEDEIADSVFMKSYIPKSLDAVNNPEADVAKITSGQDTGDMLYQTITGLKDALPKVDEQQIEVNAEEEEEEEEEGSGEESEEESEEELGPEDKKAARKEHKKKVKEEKRESRKTKTPKSVKKRKKKVSKPHKTR

SEQ ID NO: 5844 - protein, 531 aa, Arabidopsis thaliana
  misc_feature (1)..(531): useful for making plants with modified plant phenotypes as described in USSN 12/139,269
  misc_feature (1)..(531): Public GI no. 51970844
  misc_feature (1)..(531): Utility: Useful for delaying flowering time
  misc_feature (1)..(531): Utility: Useful for making ornamental plants with modified leaves
  misc_feature (1)..(531): Utility: Useful for making plants with increased biomass and foliage
  misc_feature (1)..(531): Utility: Useful for making smaller plants
MEEVVVVAEPPPKITPFVEYEEELEDDDDDLSLSSDSDIAEALDWLDGKDDDELIGGGFSLHARRPNAHGGHGSRPNSSALQPISNKAQKLTSHVRASPLEGWEGRVKVGMSNSVTTAIRGSLRDTEIGRSRNTDKADRATVEQALDPRTRMVLFRMLNRGVFNDVNGCISTGKEANVYHATKSDGSELAIKVYKTSVLVFKDRDRYVQGDYRFRYGYCRHNPRKMVKTWAEKEQRNLKRLHAAGIRCPAVILLRLHVLVMEFIGRDGWAAPRLKDAALSLDKLRECYLKLIIQMRVLYQKCKLVHGDLSEYNILYFEGHLYIIDVSQSVDLDHPLALNFLREDCDHVSDFFKKHGVAVMTIRELFDFIVDPTISDENVDSYLEEVQRKVIERGEISVEDEIADSVFMKSYIPKSLDAVNNPEADVAKITSGQDTGDMLYQTITGLKDALPKVGEQQIEVNAEEEEEEEEEGSGEESEEESEKELGPEDKKAARKEHKKKVKEEKRESRKTKTPKSVKKRKKKVSKPHKTR

SEQ ID NO: 5845 - protein, 537 aa, Arabidopsis thaliana
  misc_feature (1)..(537): useful for making plants with modified plant phenotypes as described in USSN 12/139,269
  misc_feature (1)..(537): Ceres CLONE ID no. 1197765
  misc_feature (1)..(537): Utility: Useful for delaying flowering time
  misc_feature (1)..(537): Utility: Useful for making ornamental plants with modified leaves
  misc_feature (1)..(537): Utility: Useful for making plants with increased biomass and foliage
  misc_feature (1)..(537): Utility: Useful for making smaller plants
MEEVVLVTEPPPTIPPVVEYEEEHDDDDDDDLSLSSDSDIAEALDWLDGKDDDELIGGGFSLHARRPNAHGGHGSRPNSSSLQPISNKAQKLTSHVRASPLEGWEGRVKVGMSNSVTTAIRGSLRDTEIGRSRNTDKADRATVEQALDPRTRMVLFRMLNRGVFNDVNGCISTGKEANVYHATKSDGSELAIKVYKTSVLVFKDRDRYVQGDYRFRYGYCRHNPRKMVKTWAEKEQRNLKRLHAAGIRCPAVILLRLHVLVMEFIGRDGWAAPRLKDAALSLDKLRECYLELIIQMRVLYQKCKLVHGDLSEYNILYFEGHLYIIDVSQSVDLDHPLALNFLREDCDHVSDFFKKHGVAVMTIRELFDFIVDPAITDENVDSYLEEVQRKVIERGEISVEDEIADSVFMKSYIPKSLDAVNNPEADVAKITSGQDTGDMLYQTITGLKDALPKIEEQKIEVNDEEKEEEGEEEEDGESEEGSEEEESEEELGHEDKKAARKEHKKKVKEEKRESRKTKTPKSVKKRKKKVSKPHKTR

SEQ ID NO: 5846 - protein, 537 aa, Arabidopsis thaliana; identical to SEQ ID NO: 5845
  misc_feature (1)..(537): useful for making plants with modified plant phenotypes as described in USSN 12/139,269
  misc_feature (1)..(537): Public GI no. 4559353
  misc_feature (1)..(537): Utility: Useful for delaying flowering time
  misc_feature (1)..(537): Utility: Useful for making ornamental plants with modified leaves
  misc_feature (1)..(537): Utility: Useful for making plants with increased biomass and foliage
  misc_feature (1)..(537): Utility: Useful for making smaller plants

SEQ ID NO: 5847 - protein, 562 aa, Arabidopsis thaliana
  misc_feature (1)..(562): useful for making plants with modified plant phenotypes as described in USSN 12/139,269
  misc_feature (1)..(562): Public GI no. 45476407
  misc_feature (1)..(562): Utility: Useful for delaying flowering time
  misc_feature (1)..(562): Utility: Useful for making ornamental plants with modified leaves
  misc_feature (1)..(562): Utility: Useful for making plants with increased biomass and foliage
  misc_feature (1)..(562): Utility: Useful for making smaller plants
MAEPADKLEKPQNAENEKEAAVVDEELEEEEEEEDEEGELSWSSDSEIGEALDYLDTKDDSESINGAFSLQTRRPNAHGGLHSRPNSSALQPLSNRTQKFSNHIRASPLEEWEGRIKVGMSNSVTTAIRGSVRDMAIGKTKTTEKADRATVEQAIDPRTRMVLFKMLNRGVFHDINGCISTGKEANVYHATKADGQELAIKVYKTSVLVFKDRDRYVQGDYRFRYGYCKHNPRKMVKTWAEKEMRNLMRLRAAGIRCPAPLLLRLHVLVMEFIGKGGWAAPRLKDAALSLDKLRECYVEIIMAMRTLYQKCKLVHGDLSEYNILYYEGHLYVIDVSQSVDLDHPHALDFLREDCVHVSDFFKKHGVAVMTIRELFDFIVDPTIDDDSVDSYLEKVQEKIMARGEMTAEEEIADSVFIQSFIPKTLDHVKDAEADVQRIISGEDTGDMYYKTITGLKQALSGTNPSAENQQHEQNGERGPEAAAEIDKESDGELETESDDDDESDSSEGFSSDGEKQTAAEKKTARKENKKKVKEEKREARKHKVPKAVKKKKKKLAKAKKYR

SEQ ID NO: 5848 - protein, 420 aa, Glycine max
  misc_feature (1)..(420): useful for making plants with modified plant phenotypes as described in USSN 12/139,269
  misc_feature (1)..(420): Ceres CLONE ID no. 512325
  misc_feature (1)..(420): Utility: Useful for delaying flowering time
  misc_feature (1)..(420): Utility: Useful for making ornamental plants with modified leaves
  misc_feature (1)..(420): Utility: Useful for making plants with increased biomass and foliage
  misc_feature (1)..(420): Utility: Useful for making smaller plants
  misc_feature (80)..(80): Xaa is any aa, unknown or other
  misc_feature (95)..(95): Xaa is any aa, unknown or other
  misc_feature (107)..(107): Xaa is any aa, unknown or other
  misc_feature (125)..(125): Xaa is any aa, unknown or other
  misc_feature (393)..(393): Xaa is any aa, unknown or other
MNVGMSNSVTTAIRGSVRDMAIGKTKTTEKADRATVEQAIDPRTRMVLFKMLNRGVFHDINGCISTGKEANVYHATKSDXQELAIKVYKTSVLVXKDRDRYVQGDFXFRNGYCKHNPRKMVKTWXEKEMRNLMRLKAAGIRCPTPYLLRLHVLVMEFIGKSGWAAPRLKDAALSLDKLREGYVEIIIAMRTLYQKCKLVHGDLSEYNILYFEGHLYIIDVSQAVDPEHPHALDFLREDCVHVSDFFKKHGVAVMTIRELFEFIVDASITDDAVDSYLEEMQQKILTRGDISAEDEIADSVFVQSYIPKTLEDVKNAEEDVQRITSGKDTKDLYYQTITGLKHALSLTQPSQQKTQQKSSPTKDSPAVSDDKSKLLEDDAEGQSDEDEDDESNXEEDSPSESEVDDPADKKAARKEVRKEN

SEQ ID NO: 5849 - protein, 496 aa, Glycine max
  misc_feature (1)..(496): useful for making plants with modified plant phenotypes as described in USSN 12/139,269
  misc_feature (1)..(496): Public GI no. 50934355
  misc_feature (1)..(496): Utility: Useful for delaying flowering time
  misc_feature (1)..(496): Utility: Useful for making ornamental plants with modified leaves
  misc_feature (1)..(496): Utility: Useful for making plants with increased biomass and foliage
  misc_feature (1)..(496): Utility: Useful for making smaller plants
MKRSGRTPTWPMRSTGSTPRRPNAHGGVLSRPFQPISNRTQKLASHIRATPLEEWEGRMNVGMSNSVTTAIRDSIRETAIGKTRNTEKADRATVEQAIDPRTRMVLFKMLNRGVFNTINGCISTGKEANVYHASKADGQELAIKVYKTSVLVFKDRDRYVHGDYRFRHGYCKHNPRKMVKTWAEKEMRNLLRVGAAGIRCPKPLLLRLHVLVMEFIGKGGWAAPRLKDAALSDDKLRESYFELITTMRTLYQKCKLVHGDLSEYNILYFEGHLYIIDVSQSVDLDHPSALEFLKEDCLHVTDFFKKRGVAVMSVTELFNFVIDQNIADEDVDHYLEKIQQKMLENGDMVANDDEITPTVLVQTLDYVKQCEADIVNMSLMQRPSFANEPTADKLYNQPLLGFVRNKNEPTKNQQVQSEEPLDLQNKCSSEHSESCTSSDEDGSWHEILKVGPEERKAARKENKKKVKAEKREARKDKIPKAEKKKRKKMAKAKCKR

SEQ ID NO: 5850 - protein, 532 aa, Zea mays
  misc_feature (1)..(532): useful for making plants with modified plant phenotypes as described in USSN 12/139,269
  misc_feature (1)..(532): Ceres CLONE ID no. 297520
  misc_feature (1)..(532): Utility: Useful for delaying flowering time
  misc_feature (1)..(532): Utility: Useful for making ornamental plants with modified leaves
  misc_feature (1)..(532): Utility: Useful for making plants with increased biomass and foliage
  misc_feature (1)..(532): Utility: Useful for making smaller plants
MALVKSDAEEEWSDSDFDDASDSEVAEALDWLDAVEGPDGSARPHVAFSASGGGAAARRPNAHGGVLSRPLQPLSNRTQKLASHISATPLEEWEGRMNVAMSNSVTTAIRDSIRDTAIGKIRNTEKADRATVEQAIDPRTRMVLFKMLNRGVFNNINGCISTGKEANVYHATKTDGQELAIKVYKTSVLVFKDRDRYVQGDYRFRHGYCKHNPRKMVKTWAEKEMRNLLRVRAAGIRCPAPLLLRLHVLVMEFIGKGGWAAPRLKDAALSDDKLHESYFEIITTMRTLYQTCKLVHGDLSEYNILYFEGHLYIIDVSQSVDLDHPSALDFLKEDCLHVSDFFKKRGVPVMTVTDLFNFVIDQSISDEDVDDYLEKAQQKILENGGAVPNDDEITPTVMVQTLDYVKQCEADIVNMSIMQRSSSGYEPTADKLYDQPLLGFVRTKNTNTEKEQGQPARNLVEVEEDESESCLSSDEDDSWHEDDPKVGPEERKAARKENKKKVKEEKREARKTKIPKAEKKKRKKMAKAKCKR

SEQ ID NO: 5851 - DNA, 884 bp, Arabidopsis thaliana; identical to SEQ ID NO: 5232
  misc_feature (1)..(884): useful for making plants with modified plant phenotypes as described in USSN 12/139,269
  misc_feature (1)..(884): Ceres CLONE ID no. 92459
  misc_feature (1)..(884): Also known as  Ceres CDNA ID no. 23361912

SEQ ID NO: 5852 - protein, 196 aa, Arabidopsis thaliana
  misc_feature (1)..(196): useful for making plants with modified plant phenotypes as described in USSN 12/139,269
  misc_feature (117)..(166): Pfam Name: K-box; Pfam Description: K-box region
  misc_feature (9)..(59): Pfam Name: SRF-TF; Pfam Description: SRF-type transcription factor (DNA-binding and dimerisation domain)
  misc_feature (1)..(196): Utility: Useful for delaying flowering time
  misc_feature (1)..(196): Utility: Useful for increasing chlorophyll and photosynthetic capacity
  misc_feature (1)..(196): Utility: Useful for making larger plants
  misc_feature (1)..(196): Utility: Useful for making ornamental plants with modified flowers
  misc_feature (1)..(196): Utility: Useful for making ornamental plants with modified leaves
  misc_feature (1)..(196): Utility: Useful for making plants with increased biomass
  misc_feature (1)..(196): Utility: Useful for making plants with increased biomass and foliage
  misc_feature (1)..(196): Utility: Useful for making plants with increased size and biomass
  misc_feature (1)..(196): Utility: Useful for making smaller plants
  misc_feature (1)..(196): Utility: Useful for making stronger plants
  misc_feature (1)..(196): Utility: Useful for making taller plants and plants with longer inflorescences
  misc_feature (1)..(196): Utility: Useful for modifying plant architecture, ie amount of branching
MGRRKIEIKRIENKSSRQVTFSKRRNGLIDKARQLSILCESSVAVVVVSASGKLYDSSSGDDISKIIDRYEIQHADELRALDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 5853 - protein, 192 aa, Arabidopsis thaliana; identical to SEQ ID NO: 5260
  misc_feature (1)..(192): useful for making plants with modified plant phenotypes as described in USSN 12/139,269
  misc_feature (1)..(192): Ceres CLONE ID no. 98850
  misc_feature (1)..(192): Utility: Useful for delaying flowering time
  misc_feature (1)..(192): Utility: Useful for increasing chlorophyll and photosynthetic capacity
  misc_feature (1)..(192): Utility: Useful for making larger plants
  misc_feature (1)..(192): Utility: Useful for making ornamental plants with modified flowers
  misc_feature (1)..(192): Utility: Useful for making ornamental plants with modified leaves
  misc_feature (1)..(192): Utility: Useful for making plants with increased biomass
  misc_feature (1)..(192): Utility: Useful for making plants with increased biomass and foliage
  misc_feature (1)..(192): Utility: Useful for making plants with increased size and biomass
  misc_feature (1)..(192): Utility: Useful for making smaller plants
  misc_feature (1)..(192): Utility: Useful for making stronger plants
  misc_feature (1)..(192): Utility: Useful for making taller plants and plants with longer inflorescences
  misc_feature (1)..(192): Utility: Useful for modifying plant architecture, ie amount of branching

SEQ ID NO: 5854 - protein, 192 aa, Arabidopsis thaliana; identical to SEQ ID NO: 5260
  misc_feature (1)..(192): useful for making plants with modified plant phenotypes as described in USSN 12/139,269
  misc_feature (1)..(192): Public GI no. 11545547
  misc_feature (1)..(192): Utility: Useful for delaying flowering time
  misc_feature (1)..(192): Utility: Useful for increasing chlorophyll and photosynthetic capacity
  misc_feature (1)..(192): Utility: Useful for making larger plants
  misc_feature (1)..(192): Utility: Useful for making ornamental plants with modified flowers
  misc_feature (1)..(192): Utility: Useful for making ornamental plants with modified leaves
  misc_feature (1)..(192): Utility: Useful for making plants with increased biomass
  misc_feature (1)..(192): Utility: Useful for making plants with increased biomass and foliage
  misc_feature (1)..(192): Utility: Useful for making plants with increased size and biomass
  misc_feature (1)..(192): Utility: Useful for making smaller plants
  misc_feature (1)..(192): Utility: Useful for making stronger plants
  misc_feature (1)..(192): Utility: Useful for making taller plants and plants with longer inflorescences
  misc_feature (1)..(192): Utility: Useful for modifying plant architecture, ie amount of branching

SEQ ID NO: 5855 - protein, 197 aa, Arabidopsis thaliana
  misc_feature (1)..(197): useful for making plants with modified plant phenotypes as described in USSN 12/139,269
  misc_feature (1)..(197): Public GI no. 2829920
  misc_feature (1)..(197): Utility: Useful for delaying flowering time
  misc_feature (1)..(197): Utility: Useful for increasing chlorophyll and photosynthetic capacity
  misc_feature (1)..(197): Utility: Useful for making larger plants
  misc_feature (1)..(197): Utility: Useful for making ornamental plants with modified flowers
  misc_feature (1)..(197): Utility: Useful for making ornamental plants with modified leaves
  misc_feature (1)..(197): Utility: Useful for making plants with increased biomass
  misc_feature (1)..(197): Utility: Useful for making plants with increased biomass and foliage
  misc_feature (1)..(197): Utility: Useful for making plants with increased size and biomass
  misc_feature (1)..(197): Utility: Useful for making smaller plants
  misc_feature (1)..(197): Utility: Useful for making stronger plants
  misc_feature (1)..(197): Utility: Useful for making taller plants and plants with longer inflorescences
  misc_feature (1)..(197): Utility: Useful for modifying plant architecture, ie amount of branching
MGRRKIEIKRIENKSSRQVTFSKRRNGLIDKARQLSILCESSVAVVVVSASGKLYDSSSVIVSTGKYKNFTIFLTIPFLHVQDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 5856 - protein, 205 aa, Arabidopsis thaliana
  misc_feature (1)..(205): useful for making plants with modified plant phenotypes as described in USSN 12/139,269
  misc_feature (1)..(205): Public GI no. 51968502
  misc_feature (1)..(205): Utility: Useful for delaying flowering time
  misc_feature (1)..(205): Utility: Useful for increasing chlorophyll and photosynthetic capacity
  misc_feature (1)..(205): Utility: Useful for making larger plants
  misc_feature (1)..(205): Utility: Useful for making ornamental plants with modified flowers
  misc_feature (1)..(205): Utility: Useful for making ornamental plants with modified leaves
  misc_feature (1)..(205): Utility: Useful for making plants with increased biomass
  misc_feature (1)..(205): Utility: Useful for making plants with increased biomass and foliage
  misc_feature (1)..(205): Utility: Useful for making plants with increased size and biomass
  misc_feature (1)..(205): Utility: Useful for making smaller plants
  misc_feature (1)..(205): Utility: Useful for making stronger plants
  misc_feature (1)..(205): Utility: Useful for making taller plants and plants with longer inflorescences
  misc_feature (1)..(205): Utility: Useful for modifying plant architecture, ie amount of branching
MCRKSEAMGRRRVEIKRIENKSSRQVTFCKRRNGLMEKARQLSILCGSSVALFIVSSTGKLYNSSSGDSMAKIISRFKIQQADDPETLDLEDKTQDYLSHKELLEIVQRKIEEAKGDNVSIESLISMEEQLKSALSVIRARKTELLMELVKNLQDKEKLLKEKNKVLASEVGKLKKILETGDERAVMSPENSSGHSPPETLPLLK

SEQ ID NO: 5857 - protein, 197 aa, Brassica napus
  misc_feature (1)..(197): useful for making plants with modified plant phenotypes as described in USSN 12/139,269
  misc_feature (1)..(197): Ceres CLONE ID no. 963001
  misc_feature (1)..(197): Utility: Useful for delaying flowering time
  misc_feature (1)..(197): Utility: Useful for increasing chlorophyll and photosynthetic capacity
  misc_feature (1)..(197): Utility: Useful for making larger plants
  misc_feature (1)..(197): Utility: Useful for making ornamental plants with modified flowers
  misc_feature (1)..(197): Utility: Useful for making ornamental plants with modified leaves
  misc_feature (1)..(197): Utility: Useful for making plants with increased biomass
  misc_feature (1)..(197): Utility: Useful for making plants with increased biomass and foliage
  misc_feature (1)..(197): Utility: Useful for making plants with increased size and biomass
  misc_feature (1)..(197): Utility: Useful for making smaller plants
  misc_feature (1)..(197): Utility: Useful for making stronger plants
  misc_feature (1)..(197): Utility: Useful for making taller plants and plants with longer inflorescences
  misc_feature (1)..(197): Utility: Useful for modifying plant architecture, ie amount of branching
MGRKKLEIKRIENKSSRQVTFSKRRSGLIEKARQLSVLCDASVALLVVSSSGKLYSFSAGDNLVRILDRYGKQHADDLKALNLQSKALSYGSHNELLELVDSKLVESNVGGVSVDTLVQLEGVLENALSLTRARKTELMLKLVDSLKEKEKLLKEENQALAGQKEKKNLAGAEADNMEMSPGQISDINLPVTLPLLN

SEQ ID NO: 5858 - DNA, 641 bp, Arabidopsis thaliana
  misc_feature (1)..(641): useful for making plants with modified plant phenotypes as described in USSN 12/139,269
  misc_feature (1)..(641): Ceres CLONE ID no. 92670
  misc_feature (1)..(641): Also known as  Ceres CDNA ID no. 23383902
aaaaccctaaggtaaacctgagagaacaagccagagctaatctcttgtcggaaggaagaaggatcaaaaatgccgctctacgactgtatgcttctgttcaagcctataatcaggaaggagggcctcatcgacctcgttgcgcgcattggtaaacacgtttacagcagaaatggcgtcctcaccgagatcaaatcctttggcaaggtcgaattgggttacggtattagaaagctcgacggaagacactatcagggacaattgatgcagataacaatgatgacaactccaaacatgaacaaggagcttcactacctgaacaaggaagacaaactgctacgctggctcttagttaaacaccgtgacatcaagattggacagtcggaaaaggaagatagtctgactgtgcctaacagactcactagtgggagcttatatgatggatcctcctcggacgaagatgacaacaacattttagggttatcacgatgaggaaatcaatttctttgaaatgtttactcagacaatttcttcatgggagtccccttcaatggttatgaatgtttttggttacataaagtggtggtatgcgttttgcgtagacaatgaaataaattaattttatgtaataataatttttaggc

SEQ ID NO: 5859 - protein, 139 aa, Arabidopsis thaliana
  misc_feature (1)..(139): useful for making plants with modified plant phenotypes as described in USSN 12/139,269
  misc_feature (1)..(139): Utility: Useful for delaying flowering time
  misc_feature (1)..(139): Utility: Useful for increasing increasing anthocyanin content
  misc_feature (1)..(139): Utility: Useful for making lethal plants for genetic confinement systems
  misc_feature (1)..(139): Utility: Useful for making ornamental plants with modified leaves
  misc_feature (1)..(139): Utility: Useful for making plants with increased biomass and foliage
  misc_feature (1)..(139): Utility: Useful for making smaller plants
  misc_feature (1)..(139): Utility: Useful for making stronger plants
MPLYDCMLLFKPIIRKEGLIDLVARIGKHVYSRNGVLTEIKSFGKVELGYGIRKLDGRHYQGQLMQITMMTTPNMNKELHYLNKEDKLLRWLLVKHRDIKIGQSEKEDSLTVPNRLTSGSLYDGSSSDEDDNNILGLSR

SEQ ID NO: 5860 - protein, 126 aa, Brassica napus
  misc_feature (1)..(126): useful for making plants with modified plant phenotypes as described in USSN 12/139,269
  misc_feature (1)..(126): Ceres CLONE ID no. 1067750
  misc_feature (1)..(126): Utility: Useful for delaying flowering time
  misc_feature (1)..(126): Utility: Useful for increasing increasing anthocyanin content
  misc_feature (1)..(126): Utility: Useful for making lethal plants for genetic confinement systems
  misc_feature (1)..(126): Utility: Useful for making ornamental plants with modified leaves
  misc_feature (1)..(126): Utility: Useful for making plants with increased biomass and foliage
  misc_feature (1)..(126): Utility: Useful for making smaller plants
  misc_feature (1)..(126): Utility: Useful for making stronger plants
MPLYDCMLLFKPIIRKEGLIDLVARIGKHVYSKNGVLTEVKSFGKVELGYGIKKLDGRHYQGQLMQITMMATPNINKELHYLNKEDKLLRWLLVKHRDIKIGSSEMEDRLDESNRVTNRSLYDESS

SEQ ID NO: 5861 - protein, 116 aa, Brassica napus
  misc_feature (1)..(116): useful for making plants with modified plant phenotypes as described in USSN 12/139,269
  misc_feature (1)..(116): Ceres CLONE ID no. 1259129
  misc_feature (1)..(116): Utility: Useful for delaying flowering time
  misc_feature (1)..(116): Utility: Useful for increasing increasing anthocyanin content
  misc_feature (1)..(116): Utility: Useful for making lethal plants for genetic confinement systems
  misc_feature (1)..(116): Utility: Useful for making ornamental plants with modified leaves
  misc_feature (1)..(116): Utility: Useful for making plants with increased biomass and foliage
  misc_feature (1)..(116): Utility: Useful for making smaller plants
  misc_feature (1)..(116): Utility: Useful for making stronger plants
MLLFKPVIRKEGLIELVARIGKHVYSRNGVLTEVKSFGKVELGYGIRKLDGRHYQGQLMQITMMATPNMNKELHYLNKEDKLLRWLLVKHRHIKIGASEMEDRQDESSRVTNNRSL

SEQ ID NO: 5862 - protein, 132 aa, Brassica napus
  misc_feature (1)..(132): useful for making plants with modified plant phenotypes as described in USSN 12/139,269
  misc_feature (1)..(132): Ceres CLONE ID no. 981652
  misc_feature (1)..(132): Utility: Useful for delaying flowering time
  misc_feature (1)..(132): Utility: Useful for increasing increasing anthocyanin content
  misc_feature (1)..(132): Utility: Useful for making lethal plants for genetic confinement systems
  misc_feature (1)..(132): Utility: Useful for making ornamental plants with modified leaves
  misc_feature (1)..(132): Utility: Useful for making plants with increased biomass and foliage
  misc_feature (1)..(132): Utility: Useful for making smaller plants
  misc_feature (1)..(132): Utility: Useful for making stronger plants
MLLFKPVIRKEGLIDLVARIGKHVYSKNGVLTEVKSFGKVELGYGIKKLDGRHYQGQLMQITMMATPNINKELHYLNKEDKLLRWLLVKHRDIKIGSSEMEDRLDESNRVTNRSLYDESSTDEDDDVLGLSR

SEQ ID NO: 5863 - protein, 103 aa, Triticum aestivum
  misc_feature (1)..(103): useful for making plants with modified plant phenotypes as described in USSN 12/139,269
  misc_feature (1)..(103): Ceres CLONE ID no. 937515
  misc_feature (1)..(103): Utility: Useful for delaying flowering time
  misc_feature (1)..(103): Utility: Useful for increasing increasing anthocyanin content
  misc_feature (1)..(103): Utility: Useful for making lethal plants for genetic confinement systems
  misc_feature (1)..(103): Utility: Useful for making ornamental plants with modified leaves
  misc_feature (1)..(103): Utility: Useful for making plants with increased biomass and foliage
  misc_feature (1)..(103): Utility: Useful for making smaller plants
  misc_feature (1)..(103): Utility: Useful for making stronger plants
  misc_feature (12)..(12): Xaa is any aa, unknown or other
  misc_feature (22)..(22): Xaa is any aa, unknown or other
  misc_feature (97)..(97): Xaa is any aa, unknown or other
MPLYDCMLMVKXLVTKEAIAEXVARVAARAYQRNGVVTELKSFGKVQLGYGIRKLDGRHFQGQLLQMTMMVPPSFTQELHYLNKEDRLLRWLVVKHXDAVYGL

SEQ ID NO: 5864 - protein, 163 aa, Zea mays
  misc_feature (1)..(163): useful for making plants with modified plant phenotypes as described in USSN 12/139,269
  misc_feature (1)..(163): Ceres CLONE ID no. 260168
  misc_feature (1)..(163): Utility: Useful for delaying flowering time
  misc_feature (1)..(163): Utility: Useful for increasing increasing anthocyanin content
  misc_feature (1)..(163): Utility: Useful for making lethal plants for genetic confinement systems
  misc_feature (1)..(163): Utility: Useful for making ornamental plants with modified leaves
  misc_feature (1)..(163): Utility: Useful for making plants with increased biomass and foliage
  misc_feature (1)..(163): Utility: Useful for making smaller plants
  misc_feature (1)..(163): Utility: Useful for making stronger plants
MPLYDCMLLLKTTVTREVLAELVTRVARRACQRNGVVTDVKSFGKVSLAYGIRKLDGRHFQGHLMQMTMMVPPSFPQELHYLNKEDRLLRWLVVKHRDTVYGLEFLNADGGRDELRSFSHGHTKGDYDIEIDSDDEDSDDSDDEEYAIEEEEEEEAANDEEKK

SEQ ID NO: 5865 - protein, 138 aa, Glycine max
  misc_feature (1)..(138): useful for making plants with modified plant phenotypes as described in USSN 12/139,269
  misc_feature (1)..(138): Ceres CLONE ID no. 599515
  misc_feature (1)..(138): Utility: Useful for delaying flowering time
  misc_feature (1)..(138): Utility: Useful for increasing increasing anthocyanin content
  misc_feature (1)..(138): Utility: Useful for making lethal plants for genetic confinement systems
  misc_feature (1)..(138): Utility: Useful for making ornamental plants with modified leaves
  misc_feature (1)..(138): Utility: Useful for making plants with increased biomass and foliage
  misc_feature (1)..(138): Utility: Useful for making smaller plants
  misc_feature (1)..(138): Utility: Useful for making stronger plants
MFLFKPHIRKEAVMDLVVRVGKHVCRRNGVVTDIKSLGKVQLGYGVKKLDGRYYQGLLMQMSMMATPEINKELHYLNKEDRLLRWLLVKQRNTKFGLDSYGDEGRYELSKLSQIGKHGDEDEDEDDEEYEVNEEETVN

SEQ ID NO: 5866 - protein, 152 aa, Triticum aestivum
  misc_feature (1)..(152): useful for making plants with modified plant phenotypes as described in USSN 12/139,269
  misc_feature (1)..(152): Ceres CLONE ID no. 685681
  misc_feature (1)..(152): Utility: Useful for delaying flowering time
  misc_feature (1)..(152): Utility: Useful for increasing increasing anthocyanin content
  misc_feature (1)..(152): Utility: Useful for making lethal plants for genetic confinement systems
  misc_feature (1)..(152): Utility: Useful for making ornamental plants with modified leaves
  misc_feature (1)..(152): Utility: Useful for making plants with increased biomass and foliage
  misc_feature (1)..(152): Utility: Useful for making smaller plants
  misc_feature (1)..(152): Utility: Useful for making stronger plants
MPLYDCMLMVKPMVTKEAIAELVARVAARAYQRNGVVTELKSFGKVHLGYGIRKLDGRHFQGQLLQMTMMVPPSFTQELHYLNKEDRLLRWLVVKHRDAVYGLEFINEDDGRYEMDSFRRKSTTTQDDEDVDEYDDDDDDDDDDDEYDVQEE

SEQ ID NO: 5867 - protein, 144 aa, Glycine max
  misc_feature (1)..(144): useful for making plants with modified plant phenotypes as described in USSN 12/139,269
  misc_feature (1)..(144): Ceres CLONE ID no. 1074266
  misc_feature (1)..(144): Utility: Useful for delaying flowering time
  misc_feature (1)..(144): Utility: Useful for increasing increasing anthocyanin content
  misc_feature (1)..(144): Utility: Useful for making lethal plants for genetic confinement systems
  misc_feature (1)..(144): Utility: Useful for making ornamental plants with modified leaves
  misc_feature (1)..(144): Utility: Useful for making plants with increased biomass and foliage
  misc_feature (1)..(144): Utility: Useful for making smaller plants
  misc_feature (1)..(144): Utility: Useful for making stronger plants
MPPYDCMFLFKPHIRKEAVMDLVVRVGKHVCRRNGVVIDIKSLGRVQLGYGVKKLDGRYYQGLLMQMSMMATPEINKELHYLNKEDRLLRWLLVKQRNTKFGLDSYGDEGRYELSKFSQIGKHGDEDEDEDDEEYEVNEEETVN

SEQ ID NO: 5868 - protein, 146 aa, Glycine max
  misc_feature (1)..(146): useful for making plants with modified plant phenotypes as described in USSN 12/139,269
  misc_feature (1)..(146): Public GI no. 34904072
  misc_feature (1)..(146): Utility: Useful for delaying flowering time
  misc_feature (1)..(146): Utility: Useful for increasing increasing anthocyanin content
  misc_feature (1)..(146): Utility: Useful for making lethal plants for genetic confinement systems
  misc_feature (1)..(146): Utility: Useful for making ornamental plants with modified leaves
  misc_feature (1)..(146): Utility: Useful for making plants with increased biomass and foliage
  misc_feature (1)..(146): Utility: Useful for making smaller plants
  misc_feature (1)..(146): Utility: Useful for making stronger plants
MPLYDCMLLVKPLVTREAMAELVGRVARRAYQRNGVVTDVKSFGTICLGYGIKKLDGRHFKGQLMQMTMMVPPSFTQELHYLNKEDRLLRWLVVKHRDAVYGVEFINEDDGRREMTDFRYRTKDEASDVDEYDDDDDDYEYEIDEE

SEQ ID NO: 5869 - protein, 108 aa, Zea mays
  misc_feature (1)..(108): useful for making plants with modified plant phenotypes as described in USSN 12/139,269
  misc_feature (1)..(108): Ceres CLONE ID no. 894996
  misc_feature (1)..(108): Utility: Useful for delaying flowering time
  misc_feature (1)..(108): Utility: Useful for increasing increasing anthocyanin content
  misc_feature (1)..(108): Utility: Useful for making lethal plants for genetic confinement systems
  misc_feature (1)..(108): Utility: Useful for making ornamental plants with modified leaves
  misc_feature (1)..(108): Utility: Useful for making plants with increased biomass and foliage
  misc_feature (1)..(108): Utility: Useful for making smaller plants
  misc_feature (1)..(108): Utility: Useful for making stronger plants
  misc_feature (103)..(103): Xaa is any aa, unknown or other
MQMTMMVPPSLPREHSLNKEDRLLRFCWLVVKHRDAVYGLEFVNEDGGRNELSGFSLAHRKDDYDTELASDDEDSDSDSDTTSMRSRRRSRTAWLGFCSLICXGRCFS

SEQ ID NO: 5870 - protein, 126 aa, Zea mays
  misc_feature (1)..(126): useful for making plants with modified plant phenotypes as described in USSN 12/139,269
  misc_feature (1)..(126): Ceres CLONE ID no. 1466424
  misc_feature (1)..(126): Utility: Useful for delaying flowering time
  misc_feature (1)..(126): Utility: Useful for increasing increasing anthocyanin content
  misc_feature (1)..(126): Utility: Useful for making lethal plants for genetic confinement systems
  misc_feature (1)..(126): Utility: Useful for making ornamental plants with modified leaves
  misc_feature (1)..(126): Utility: Useful for making plants with increased biomass and foliage
  misc_feature (1)..(126): Utility: Useful for making smaller plants
  misc_feature (1)..(126): Utility: Useful for making stronger plants
  misc_feature (107)..(107): Xaa is any aa, unknown or other
MQMTMMVPPSLPREHSLNKEDRLLRFCWLVVKHRDAVYGLEFVNEDGGRNELSGFSLAHRKDDYDTELASDDEDSDSDSDTTSMRSRRRSRTAWPGFCSFICVGRCXFWGLIEYVDFFYYYNLVVA

SEQ ID NO: 5871 - DNA, 943 bp, Arabidopsis thaliana
  misc_feature (1)..(943): useful for making plants with modified plant phenotypes as described in USSN 12/139,269
  misc_feature (1)..(943): Ceres CLONE ID no. 94231
  misc_feature (1)..(943): Also known as  Ceres CDNA ID no. 23471133
  misc_feature (545)..(545): r is g or a
  misc_feature (546)..(546): m is a or c
  misc_feature (547)..(547): w is a or t/u
  misc_feature (548)..(548): y is t/u or c
  misc_feature (562)..(562): w is a or t/u
  misc_feature (564)..(564): y is t/u or c
  misc_feature (570)..(570): w is a or t/u
  misc_feature (576)..(576): h is a or c or t/u
  misc_feature (577)..(577): w is a or t/u
  misc_feature (578)..(578): k is g or t/u
  misc_feature (615)..(615): k is g or t/u
  misc_feature (624)..(624): s is g or c
  misc_feature (625)..(625): r is g or a
  misc_feature (642)..(642): s is g or c
  misc_feature (719)..(719): s is g or c
attttttttcataattgtatcaaattgtgagaggaaaaaaagaagttcaagaaatggagaaggaaggactcgggcttgagataacggagctgagattggggcttccggggagagatgtggcagagaagatgatgaagaagagagctttcacggagatgaatatgacgtcgtcgggtagtaatagtgatcaatgtgaaagcggcgtcgtttcatctggtggtgacgctgagaaggttaatgattcgccggcggcgaaaagccaggtggtggggtggccaccggtttgttcttaccggaagaaaaacagctgtaaggaagcttcgaccacgaaagtgggttagggtatgtgaaagtgagcatggatggtgtgccttatttgaggaagatggatcttggttcgagccaaggctatgatgatctagccttttctcttgataagctcttcggtttccgtggcatcggtgtggccttgaaagatggtgacaactgcgaatacgttaccatatacgaagacaaagatggagactggatgctcgccggtgatrmwycttgggggatgtgwtytagagwcatgchwkaggttgagaataatgaaaagatcggatgctaccgggkttgggctgsrgcctagaggagtagacsagtgatgatgacttgaacaagaagcaaggagctggttcattaatttaatcttaaatttgatcatcaagatcctttasaacatttttcctattcatgttatataaatatatatgttatagtatattatttgcaacaaaatttcaagttatggtttgcataattatcttcagaaagacagctatatatatatacactacttgtttcttgagtgttgagttaaaacattaatctgtttcaaaatttattgttatttcggatctatatatgtgtgtagaaacatatgtaataagtatccattatt

SEQ ID NO: 5872 - protein, 95 aa, Arabidopsis thaliana
  misc_feature (1)..(95): useful for making plants with modified plant phenotypes as described in USSN 12/139,269
  misc_feature (6)..(90): Pfam Name: AUX_IAA; Pfam Description: AUX/IAA family
  misc_feature (1)..(95): Utility: Useful for delaying flowering time
  misc_feature (1)..(95): Utility: Useful for increasing chlorophyll and photosynthetic capacity
  misc_feature (1)..(95): Utility: Useful for making ornamental plants with modified flowers
  misc_feature (1)..(95): Utility: Useful for making ornamental plants with modified leaves
  misc_feature (1)..(95): Utility: Useful for making plants with altered leaf shape eg curled leaves
  misc_feature (1)..(95): Utility: Useful for making smaller plants
  misc_feature (1)..(95): Utility: Useful for making stronger plants
MEKEGLGLEITELRLGLPGRDVAEKMMKKRAFTEMNMTSSGSNSDQCESGVVSSGGDAEKVNDSPAAKSQVVGWPPVCSYRKKNSCKEASTTKVG

SEQ ID NO: 5873 - protein, 42 aa, Arabidopsis thaliana
  misc_feature (1)..(42): useful for making plants with modified plant phenotypes as described in USSN 12/139,269
  misc_feature (1)..(42): Ceres CLONE ID no. 121353
  misc_feature (1)..(42): Utility: Useful for delaying flowering time
  misc_feature (1)..(42): Utility: Useful for increasing chlorophyll and photosynthetic capacity
  misc_feature (1)..(42): Utility: Useful for making ornamental plants with modified flowers
  misc_feature (1)..(42): Utility: Useful for making ornamental plants with modified leaves
  misc_feature (1)..(42): Utility: Useful for making plants with altered leaf shape eg curled leaves
  misc_feature (1)..(42): Utility: Useful for making smaller plants
  misc_feature (1)..(42): Utility: Useful for making stronger plants
MEKEGLGLEITELRLGLPGRDVAEKMMKKMFFVQASTVTEHH

SEQ ID NO: 5874 - protein, 172 aa, Brassica napus
  misc_feature (1)..(172): useful for making plants with modified plant phenotypes as described in USSN 12/139,269
  misc_feature (1)..(172): Ceres CLONE ID no. 981738
  misc_feature (1)..(172): Utility: Useful for delaying flowering time
  misc_feature (1)..(172): Utility: Useful for increasing chlorophyll and photosynthetic capacity
  misc_feature (1)..(172): Utility: Useful for making ornamental plants with modified flowers
  misc_feature (1)..(172): Utility: Useful for making ornamental plants with modified leaves
  misc_feature (1)..(172): Utility: Useful for making plants with altered leaf shape eg curled leaves
  misc_feature (1)..(172): Utility: Useful for making smaller plants
  misc_feature (1)..(172): Utility: Useful for making stronger plants
  misc_feature (160)..(160): Xaa is any aa, unknown or other
  misc_feature (166)..(166): Xaa is any aa, unknown or other
  misc_feature (168)..(168): Xaa is any aa, unknown or other
MMKKRGFTEMIMTSSGSHSEQCESSVVSSGVDVEKVNETPAVKTQVVGWPPVCSYRRKNSCKEVSTTKVGLGYVKVSMDGVPYLRKMDLGSSQGYDDLAFALDKLFGFHGIGVALKDGDNCEYVTIYEDKDGDWMLAGDVPWGMFIESCRRVRIMKRSEXTGFGLXPXGLDE

SEQ ID NO: 5875 - protein, 133 aa, Glycine max
  misc_feature (1)..(133): useful for making plants with modified plant phenotypes as described in USSN 12/139,269
  misc_feature (1)..(133): Ceres CLONE ID no. 707989
  misc_feature (1)..(133): Utility: Useful for delaying flowering time
  misc_feature (1)..(133): Utility: Useful for increasing chlorophyll and photosynthetic capacity
  misc_feature (1)..(133): Utility: Useful for making ornamental plants with modified flowers
  misc_feature (1)..(133): Utility: Useful for making ornamental plants with modified leaves
  misc_feature (1)..(133): Utility: Useful for making plants with altered leaf shape eg curled leaves
  misc_feature (1)..(133): Utility: Useful for making smaller plants
  misc_feature (1)..(133): Utility: Useful for making stronger plants
MAKEGLGLEITELRLGLPDAEHVTVVNKNEKKRAFSQIDDENSSSGGDRKIKTNKSQVVGWPPVCSYRKKNSMNEGSKMYVKVSMDGAPFLRKIDLGLHKGYSDLALALDKLFGSYGMVEALKNADNSEHVPF

SEQ ID NO: 5876 - protein, 194 aa, Glycine max
  misc_feature (1)..(194): useful for making plants with modified plant phenotypes as described in USSN 12/139,269
  misc_feature (1)..(194): Public GI no. 416640
  misc_feature (1)..(194): Utility: Useful for delaying flowering time
  misc_feature (1)..(194): Utility: Useful for increasing chlorophyll and photosynthetic capacity
  misc_feature (1)..(194): Utility: Useful for making ornamental plants with modified flowers
  misc_feature (1)..(194): Utility: Useful for making ornamental plants with modified leaves
  misc_feature (1)..(194): Utility: Useful for making plants with altered leaf shape eg curled leaves
  misc_feature (1)..(194): Utility: Useful for making smaller plants
  misc_feature (1)..(194): Utility: Useful for making stronger plants
MAKEGLGLEITELRLGLPDAEHVAVANKNGEKKNKRVFSEIDDVGDENSSSGGGGDRKMENKNQVVGWPPVCSYRKKNSVNEASKMYVKVSMDGAPFLRKMDLGMHKGYSDLAFALEKLFGCYGMVEALKNVENGEHVPIYEDKDGDWMLVGDVPWEMFMESCKRLRIMKRADAKGFGLQPKGSLKGFIESVGK

SEQ ID NO: 5877 - protein, 195 aa, Glycine max
  misc_feature (1)..(195): useful for making plants with modified plant phenotypes as described in USSN 12/139,269
  misc_feature (1)..(195): Ceres CLONE ID no. 471171
  misc_feature (1)..(195): Utility: Useful for delaying flowering time
  misc_feature (1)..(195): Utility: Useful for increasing chlorophyll and photosynthetic capacity
  misc_feature (1)..(195): Utility: Useful for making ornamental plants with modified flowers
  misc_feature (1)..(195): Utility: Useful for making ornamental plants with modified leaves
  misc_feature (1)..(195): Utility: Useful for making plants with altered leaf shape eg curled leaves
  misc_feature (1)..(195): Utility: Useful for making smaller plants
  misc_feature (1)..(195): Utility: Useful for making stronger plants
MAKEGLGLEITELRLGLPDAEHQVSVVNKKNEKKRAFSEIDDGVGDENSSSGGGDRKMETNKSQVVGWPPVCSYRKKNSMNEGASKMYVKVSMDGAPFLRKIDLGLHKGYSDLALALDKLFGCYGMVEALKNADNSEHVPIYEDKDGDWMLVGDVPWEMFMESCKRLRIMKKSDAKGFGLQPKGSLKGFIESAAK

SEQ ID NO: 5878 - protein, 195 aa, Glycine max; identical to SEQ ID NO: 5877
  misc_feature (1)..(195): useful for making plants with modified plant phenotypes as described in USSN 12/139,269
  misc_feature (1)..(195): Public GI no. 114733
  misc_feature (1)..(195): Utility: Useful for delaying flowering time
  misc_feature (1)..(195): Utility: Useful for increasing chlorophyll and photosynthetic capacity
  misc_feature (1)..(195): Utility: Useful for making ornamental plants with modified flowers
  misc_feature (1)..(195): Utility: Useful for making ornamental plants with modified leaves
  misc_feature (1)..(195): Utility: Useful for making plants with altered leaf shape eg curled leaves
  misc_feature (1)..(195): Utility: Useful for making smaller plants
  misc_feature (1)..(195): Utility: Useful for making stronger plants

SEQ ID NO: 5879 - protein, 189 aa, Glycine max
  misc_feature (1)..(189): useful for making plants with modified plant phenotypes as described in USSN 12/139,269
  misc_feature (1)..(189): Ceres CLONE ID no. 612705
  misc_feature (1)..(189): Utility: Useful for delaying flowering time
  misc_feature (1)..(189): Utility: Useful for increasing chlorophyll and photosynthetic capacity
  misc_feature (1)..(189): Utility: Useful for making ornamental plants with modified flowers
  misc_feature (1)..(189): Utility: Useful for making ornamental plants with modified leaves
  misc_feature (1)..(189): Utility: Useful for making plants with altered leaf shape eg curled leaves
  misc_feature (1)..(189): Utility: Useful for making smaller plants
  misc_feature (1)..(189): Utility: Useful for making stronger plants
MEKEAVGLEITTELRLGLPGGELPDKNEKIKKRVFSEIQAHDDDENSSSEQDRKIQTKNQVVGWPPVCSYRKKNTVNETKMYVKVSMDGAPFLRKIDLAMHKGYSELVLALEKFFGCYGIREALKDAENAEHVPIYEDKDGDWMLVGDVPWEMFIESCKRLRIMKRSDAKGFDLQPKGSLKGFIEGVTK

SEQ ID NO: 5880 - protein, 179 aa, Glycine max
  misc_feature (1)..(179): useful for making plants with modified plant phenotypes as described in USSN 12/139,269
  misc_feature (1)..(179): Public GI no. 414178
  misc_feature (1)..(179): Utility: Useful for delaying flowering time
  misc_feature (1)..(179): Utility: Useful for increasing chlorophyll and photosynthetic capacity
  misc_feature (1)..(179): Utility: Useful for making ornamental plants with modified flowers
  misc_feature (1)..(179): Utility: Useful for making ornamental plants with modified leaves
  misc_feature (1)..(179): Utility: Useful for making plants with altered leaf shape eg curled leaves
  misc_feature (1)..(179): Utility: Useful for making smaller plants
  misc_feature (1)..(179): Utility: Useful for making stronger plants
MAREGLGLEITELRLGLSCGEPKKNEKKRMFSEIDGGVEENGGSGDRKSVDKKNQVVGWPPVCSYRKKNMNEGSKMYMKVSMDGAPYLRKIDLCLHKGYLELALALEKLFDCCGIEEALKDAENCEHVPIYEDKDGDWMLVGDVPWEMFIESCKRLRIMKRSDAKGFDLQPKGSLKRFI

SEQ ID NO: 5881 - protein, 195 aa, Glycine max
  misc_feature (1)..(195): useful for making plants with modified plant phenotypes as described in USSN 12/139,269
  misc_feature (1)..(195): Public GI no. 4887018
  misc_feature (1)..(195): Utility: Useful for delaying flowering time
  misc_feature (1)..(195): Utility: Useful for increasing chlorophyll and photosynthetic capacity
  misc_feature (1)..(195): Utility: Useful for making ornamental plants with modified flowers
  misc_feature (1)..(195): Utility: Useful for making ornamental plants with modified leaves
  misc_feature (1)..(195): Utility: Useful for making plants with altered leaf shape eg curled leaves
  misc_feature (1)..(195): Utility: Useful for making smaller plants
  misc_feature (1)..(195): Utility: Useful for making stronger plants
MERTATYEKDLNLKATELRLGLPGIDEPEKQSSSASTSAKYSKKRTSSEMDNSSSGKENEQDSAPAPKAQVVGWPPVRSYRKNVLQIKKSESDNSSGMYLKVSMDGGTYLRKIDLKVYNSYPELLKALQNMFKCTIGVYTEREGYNGSDYAPTYEDKDGDWMLVGDVPWDMFLNSCRRLRIMKGSEAKGLHAYRL

SEQ ID NO: 5882 - protein, 202 aa, Glycine max
  misc_feature (1)..(202): useful for making plants with modified plant phenotypes as described in USSN 12/139,269
  misc_feature (1)..(202): Public GI no. 4887016
  misc_feature (1)..(202): Utility: Useful for delaying flowering time
  misc_feature (1)..(202): Utility: Useful for increasing chlorophyll and photosynthetic capacity
  misc_feature (1)..(202): Utility: Useful for making ornamental plants with modified flowers
  misc_feature (1)..(202): Utility: Useful for making ornamental plants with modified leaves
  misc_feature (1)..(202): Utility: Useful for making plants with altered leaf shape eg curled leaves
  misc_feature (1)..(202): Utility: Useful for making smaller plants
  misc_feature (1)..(202): Utility: Useful for making stronger plants
MERTATYEKDLNLEATELRLGLPGINEPEKQSSSASTSAKYSKKRTSSEMDNSSSGKENEQDSAPAPKAQVVGWPPVRSYRKNVLQVKKSESDNSSGMYLKVSMDGGTYLRKIDLKVYKSYPELLKALQNMFKCTIGVYTEREGYNGSEYAPTYEDKDRDWMLVGDVPWDMFINSCRRLRIMKGSEAKGLHAYRLWTYRPSN

SEQ ID NO: 5883 - protein, 208 aa, Glycine max; identical to SEQ ID NO: 2849
  misc_feature (1)..(208): useful for making plants with modified plant phenotypes as described in USSN 12/139,269
  misc_feature (1)..(208): Public GI no. 22531416
  misc_feature (1)..(208): Utility: Useful for delaying flowering time
  misc_feature (1)..(208): Utility: Useful for increasing chlorophyll and photosynthetic capacity
  misc_feature (1)..(208): Utility: Useful for making ornamental plants with modified flowers
  misc_feature (1)..(208): Utility: Useful for making ornamental plants with modified leaves
  misc_feature (1)..(208): Utility: Useful for making plants with altered leaf shape eg curled leaves
  misc_feature (1)..(208): Utility: Useful for making smaller plants
  misc_feature (1)..(208): Utility: Useful for making stronger plants

SEQ ID NO: 5884 - DNA, 815 bp, Arabidopsis thaliana
  misc_feature (1)..(815): useful for making plants with modified plant phenotypes as described in USSN 12/139,269
  misc_feature (1)..(815): Ceres CLONE ID no. 95135
  misc_feature (1)..(815): Also known as  Ceres CDNA ID no. 23386334
agaatcagccgacgtttcctcttcaccactttcctctgtttctctgtttcgctctctctacaaaatttctccatgaacatacttaacaagctaggtataggatcaagtagacaaaccaacatggatccttctccaatcgcacaagtaatcgacgacgaagctccggcgccgggaaaccagtttgctcaattcggcgccggttgtttctggagcgtggaattagcgtaccagagagttccaggagtgactcaaacagaggttggttattctcaagggatcactcacgatccttcttacaaagatgtttgttcaggtaccacgaatcatgccgagattgttcgtgttcaatatgatccaaaagagtgtagttaccagtcgctgcttgatttgttctggtctaagcatgatcccaccactttgaatcggcagggaaatgatgtgggaacccaataccgttcagggatatatttctacaacccggagcaagagaaactagcacgcgagtcactggagcggcaccagcaacaagttgacaggaaggttgtgacagagatcttaccggctaagaaattttatagagctgaggaacatcaccagcaatacttgtctaaatgagggaggtttggtcttaagcaatcaacggaaaaaggctgcaacgacccaatccgctgctacgggtaaaagccttgcttctaaccgaaagcagaggatgcttccacttatctatgatagattatagcaattatcgttgaaaaataaagaagccgaggctacttatgtaacttgttcttgttcataaaactttttaagtgttc

SEQ ID NO: 5885 - protein, 180 aa, Arabidopsis thaliana
  misc_feature (1)..(180): useful for making plants with modified plant phenotypes as described in USSN 12/139,269
  misc_feature (36)..(180): Pfam Name: PMSR; Pfam Description: Peptide methionine sulfoxide reductase
  misc_feature (1)..(180): Utility: Useful for delaying flowering time
  misc_feature (1)..(180): Utility: Useful for increasing chlorophyll and photosynthetic capacity
  misc_feature (1)..(180): Utility: Useful for making larger plants
  misc_feature (1)..(180): Utility: Useful for making ornamental plants with modified leaves
  misc_feature (1)..(180): Utility: Useful for making plants with increased biomass
  misc_feature (1)..(180): Utility: Useful for making plants with increased biomass and foliage
  misc_feature (1)..(180): Utility: Useful for making smaller plants
MNILNKLGIGSSRQTNMDPSPIAQVIDDEAPAPGNQFAQFGAGCFWSVELAYQRVPGVTQTEVGYSQGITHDPSYKDVCSGTTNHAEIVRVQYDPKECSYQSLLDLFWSKHDPTTLNRQGNDVGTQYRSGIYFYNPEQEKLARESLERHQQQVDRKVVTEILPAKKFYRAEEHHQQYLSK

SEQ ID NO: 5886 - protein, 202 aa, Arabidopsis thaliana
  misc_feature (1)..(202): useful for making plants with modified plant phenotypes as described in USSN 12/139,269
  misc_feature (1)..(202): Public GI no. 38260672
  misc_feature (1)..(202): Utility: Useful for delaying flowering time
  misc_feature (1)..(202): Utility: Useful for increasing chlorophyll and photosynthetic capacity
  misc_feature (1)..(202): Utility: Useful for making larger plants
  misc_feature (1)..(202): Utility: Useful for making ornamental plants with modified leaves
  misc_feature (1)..(202): Utility: Useful for making plants with increased biomass
  misc_feature (1)..(202): Utility: Useful for making plants with increased biomass and foliage
  misc_feature (1)..(202): Utility: Useful for making smaller plants
MNILNRLGLGSSGQTNMNPSPIAQGNDGDAPSPGNQFAQFGAGCFWGVELAFQRVPGVTQTEVGYTQGIVDKPSYEDVCSGTTGHAEVVRVQYDLNDCSYESLLDLFWSRHDPTTLNRQGNDVGTQYRSGIYFYTPEQEKLARESLERHQQQMERKIMTEILPAKKFYRAEEHHQQYLSKGGRFGLGQSTAKGCNDPIRCYG

SEQ ID NO: 5887 - protein, 202 aa, Arabidopsis thaliana
  misc_feature (1)..(202): useful for making plants with modified plant phenotypes as described in USSN 12/139,269
  misc_feature (1)..(202): Ceres CLONE ID no. 31014
  misc_feature (1)..(202): Utility: Useful for delaying flowering time
  misc_feature (1)..(202): Utility: Useful for increasing chlorophyll and photosynthetic capacity
  misc_feature (1)..(202): Utility: Useful for making larger plants
  misc_feature (1)..(202): Utility: Useful for making ornamental plants with modified leaves
  misc_feature (1)..(202): Utility: Useful for making plants with increased biomass
  misc_feature (1)..(202): Utility: Useful for making plants with increased biomass and foliage
  misc_feature (1)..(202): Utility: Useful for making smaller plants
MNILNRLGLGSSGQTNMDPSPIAQGNDDDTPAPGNQFAQFGAGCFWGVELAFQRVPGVTQTEAGYTQGTVHNPSYGDVCSGTTGHSEVVRVQYDLNDCTYESLLDLFWSRHDPTTLNRQGNDVGTQYRSGIYFYTPEQEKLARESLERHQQQMERKIMTEILPAKKFYRAEEHHQQYLSKGGRFGQGQSTAKGCNDPIRCYG

SEQ ID NO: 5888 - protein, 202 aa, Arabidopsis thaliana
  misc_feature (1)..(202): useful for making plants with modified plant phenotypes as described in USSN 12/139,269
  misc_feature (1)..(202): Public GI no. 38260657
  misc_feature (1)..(202): Utility: Useful for delaying flowering time
  misc_feature (1)..(202): Utility: Useful for increasing chlorophyll and photosynthetic capacity
  misc_feature (1)..(202): Utility: Useful for making larger plants
  misc_feature (1)..(202): Utility: Useful for making ornamental plants with modified leaves
  misc_feature (1)..(202): Utility: Useful for making plants with increased biomass
  misc_feature (1)..(202): Utility: Useful for making plants with increased biomass and foliage
  misc_feature (1)..(202): Utility: Useful for making smaller plants
MNILNRLGLGSSGQSNMDPSPIAQGNDDDAPSPGNQFAQFGAGCFWGVELAFQRVPGVTQTEVGYTQGIIDNPSYEDVCSGTTNHSEVVRVQYDPNDCSYETLLDMFWSRHDPTTLNRQGNDVGTQYRSGIYFYTPEQEKLAHESLERHQQQMERKIMTEILPAKKFYRAEEHHQQYLSKGGRFGLGQSTAKGCNDPIRCYG

SEQ ID NO: 5889 - protein, 202 aa, Arabidopsis thaliana; identical to SEQ ID NO: 5887
  misc_feature (1)..(202): useful for making plants with modified plant phenotypes as described in USSN 12/139,269
  misc_feature (1)..(202): Public GI no. 21592658
  misc_feature (1)..(202): Utility: Useful for delaying flowering time
  misc_feature (1)..(202): Utility: Useful for increasing chlorophyll and photosynthetic capacity
  misc_feature (1)..(202): Utility: Useful for making larger plants
  misc_feature (1)..(202): Utility: Useful for making ornamental plants with modified leaves
  misc_feature (1)..(202): Utility: Useful for making plants with increased biomass
  misc_feature (1)..(202): Utility: Useful for making plants with increased biomass and foliage
  misc_feature (1)..(202): Utility: Useful for making smaller plants

SEQ ID NO: 5890 - protein, 202 aa, Arabidopsis thaliana
  misc_feature (1)..(202): useful for making plants with modified plant phenotypes as described in USSN 12/139,269
  misc_feature (1)..(202): Public GI no. 38260639
  misc_feature (1)..(202): Utility: Useful for delaying flowering time
  misc_feature (1)..(202): Utility: Useful for increasing chlorophyll and photosynthetic capacity
  misc_feature (1)..(202): Utility: Useful for making larger plants
  misc_feature (1)..(202): Utility: Useful for making ornamental plants with modified leaves
  misc_feature (1)..(202): Utility: Useful for making plants with increased biomass
  misc_feature (1)..(202): Utility: Useful for making plants with increased biomass and foliage
  misc_feature (1)..(202): Utility: Useful for making smaller plants
MNILNRLGLGSSGQSNMDPSPIAQGKDDDAPSPGNQFAQFGAGCFWGVELAYQRVPGVTQTEVGYTQGIVHNPSYEDICKGTTNHTEVVRVQYDPNDCSYESLLDLFWSRHDPTTLNRQGNDVGTQYRSGIYFYTPEQEKLARASLERHQEQLDRKIMSEILPAKKFYRAEDHQQQYLSKGGRFGLGQSTAKGCNDPIRCYG

SEQ ID NO: 5891 - protein, 202 aa, Arabidopsis thaliana
  misc_feature (1)..(202): useful for making plants with modified plant phenotypes as described in USSN 12/139,269
  misc_feature (1)..(202): Public GI no. 7576185
  misc_feature (1)..(202): Utility: Useful for delaying flowering time
  misc_feature (1)..(202): Utility: Useful for increasing chlorophyll and photosynthetic capacity
  misc_feature (1)..(202): Utility: Useful for making larger plants
  misc_feature (1)..(202): Utility: Useful for making ornamental plants with modified leaves
  misc_feature (1)..(202): Utility: Useful for making plants with increased biomass
  misc_feature (1)..(202): Utility: Useful for making plants with increased biomass and foliage
  misc_feature (1)..(202): Utility: Useful for making smaller plants
MNILNRLGLGSSGQTNMDPSPIAQGNDDDTPAPGNQFAQFGAGCFWGVELAFQRVPGVTQTEAGYTQGTVDNPSYGDVCSGTTGHSEVVRVQYDLNDCTYESLLDLFWSRHDPTTLNRQGNDVGTQYRSGIYFYTPEQEKLARESLERHQQQMERKIMTEILPAKKFYRAEEHHQQYLSKGGRFGQGQSTAKGCNDPIRCYG

SEQ ID NO: 5892 - protein, 204 aa, Arabidopsis thaliana
  misc_feature (1)..(204): useful for making plants with modified plant phenotypes as described in USSN 12/139,269
  misc_feature (1)..(204): Public GI no. 4884035
  misc_feature (1)..(204): Utility: Useful for delaying flowering time
  misc_feature (1)..(204): Utility: Useful for increasing chlorophyll and photosynthetic capacity
  misc_feature (1)..(204): Utility: Useful for making larger plants
  misc_feature (1)..(204): Utility: Useful for making ornamental plants with modified leaves
  misc_feature (1)..(204): Utility: Useful for making plants with increased biomass
  misc_feature (1)..(204): Utility: Useful for making plants with increased biomass and foliage
  misc_feature (1)..(204): Utility: Useful for making smaller plants
MNILNRLGLGSSGQTNMDPSPIAQGNDDDTPAPGNQFAQFGAGCFWGVELAFQRVPGVTQTEAGYTQGTVDNPSYGDVCSGTTGHSEVVRVQYDLNDCTYESLLDLFWSRHDPTTLNRQVNDVGTHYRSGIYFYTPEQEKLARESLERHQHQQQMERKIMTEILPAKKFYRAEEHHQQYLSKGGRFGQGQSTAKGCNDPIRCYG

SEQ ID NO: 5893 - protein, 202 aa, Arabidopsis thaliana
  misc_feature (1)..(202): useful for making plants with modified plant phenotypes as described in USSN 12/139,269
  misc_feature (1)..(202): Public GI no. 38196010
  misc_feature (1)..(202): Utility: Useful for delaying flowering time
  misc_feature (1)..(202): Utility: Useful for increasing chlorophyll and photosynthetic capacity
  misc_feature (1)..(202): Utility: Useful for making larger plants
  misc_feature (1)..(202): Utility: Useful for making ornamental plants with modified leaves
  misc_feature (1)..(202): Utility: Useful for making plants with increased biomass
  misc_feature (1)..(202): Utility: Useful for making plants with increased biomass and foliage
  misc_feature (1)..(202): Utility: Useful for making smaller plants
MNILNRFGLGSGGQTSTDPSPIAQGPDDDSPAPGNHFAQFAAGCFWGVELAFQRLPGVTQTEVGYAQGITHNPSYEDVCSETTGHAEVVRVQYDPKGCTFESLLDLFWSRHDPTTLNRQGNDVGTRYRSGIYFYTPEQEKLARESLERHQQRMERKIMTQILPAKKFYRAEEQQQQYLSKGGRYGMGQSCAKGCTDPIRCYG

SEQ ID NO: 5894 - protein, 202 aa, Brassica napus
  misc_feature (1)..(202): useful for making plants with modified plant phenotypes as described in USSN 12/139,269
  misc_feature (1)..(202): Ceres CLONE ID no. 958836
  misc_feature (1)..(202): Utility: Useful for delaying flowering time
  misc_feature (1)..(202): Utility: Useful for increasing chlorophyll and photosynthetic capacity
  misc_feature (1)..(202): Utility: Useful for making larger plants
  misc_feature (1)..(202): Utility: Useful for making ornamental plants with modified leaves
  misc_feature (1)..(202): Utility: Useful for making plants with increased biomass
  misc_feature (1)..(202): Utility: Useful for making plants with increased biomass and foliage
  misc_feature (1)..(202): Utility: Useful for making smaller plants
  misc_feature (133)..(133): Xaa is any aa, unknown or other
  misc_feature (135)..(135): Xaa is any aa, unknown or other
  misc_feature (161)..(161): Xaa is any aa, unknown or other
  misc_feature (166)..(166): Xaa is any aa, unknown or other
  misc_feature (167)..(167): Xaa is any aa, unknown or other
  misc_feature (178)..(178): Xaa is any aa, unknown or other
  misc_feature (202)..(202): Xaa is any aa, unknown or other
MNILNRFGLGSGGQTSTDPSPIAQGSDDDSPAPGNHFAQFAAGCFWGVELAFQRLPGVTQTEVGYTQGITHNPSYEDVCSETTRHAEVVRVQYDPKGCTFESLLDLFWSRHDPTTLNRQGNDVGTRYRSGIYXYXPEQEKLARESLERHQQRMERKIMTEXLPAKXXYRAEEQQQQYXSKGGRYGMGQSCAKGCTDPIRCYX

SEQ ID NO: 5895 - protein, 202 aa, Glycine max
  misc_feature (1)..(202): useful for making plants with modified plant phenotypes as described in USSN 12/139,269
  misc_feature (1)..(202): Ceres CLONE ID no. 463936
  misc_feature (1)..(202): Utility: Useful for delaying flowering time
  misc_feature (1)..(202): Utility: Useful for increasing chlorophyll and photosynthetic capacity
  misc_feature (1)..(202): Utility: Useful for making larger plants
  misc_feature (1)..(202): Utility: Useful for making ornamental plants with modified leaves
  misc_feature (1)..(202): Utility: Useful for making plants with increased biomass
  misc_feature (1)..(202): Utility: Useful for making plants with increased biomass and foliage
  misc_feature (1)..(202): Utility: Useful for making smaller plants
MNLLNRLGFGSARAPENMDSSIPQGPDDDIPAPGQQFAEFGAGCFWGVELAFQRVPGVTKTEVGYTQGLVHNPTYEDVCTGTTNHSEVVRVQYDPKICSYETLLDVFWARHDPTTLNRQGNDVGTQYRSGIYYYTPEQEKAAKESLEQQQKQLNRKIVTEILPAKKFYRAEEYHQQYLEKGGRSGFKQSASKGCNDPIRCYG

SEQ ID NO: 5896 - DNA, 515 bp, Arabidopsis thaliana
  misc_feature (1)..(515): useful for making plants with modified plant phenotypes as described in USSN 12/139,269
  misc_feature (1)..(515): Ceres CLONE ID no. 97434
  misc_feature (1)..(515): Also known as  Ceres CDNA ID no. 23462257
attttcgttttcactttctccgaacatccaaaagcttgtagcttgctcctcaaatcttcttgaaaaatgaaggttgccgctgctttcctcctcgccgttttgggcggaaacgctaatccttcagccgagaatatcaaagatatcatcggagctgttggtgctgatgttgatggagagagcattgagcttctattgaaagaagtgagtggtaaggacattgctgagctgattgcttctggtagggagaaattagcgtctgtgccatctggtggtggtgtggctgtttcagctgctccatcaagcggtggtggtggtgctgctgctgctgcccctgcggagaagaaagaagccaagaaggaagagaaagaagagtctgatgatgacatgggattcagtctcttcgagtaaggtttttgtccccacggaaaggagtcgagatttgattttttgttctcttagtggttctggtttttgctcctctttgtaaccttggtctagttagcgggttttttatt

SEQ ID NO: 5897 - protein, 113 aa, Arabidopsis thaliana
  misc_feature (1)..(113): useful for making plants with modified plant phenotypes as described in USSN 12/139,269
  misc_feature (17)..(112): Pfam Name: Ribosomal_60s; Pfam Description: 60s Acidic ribosomal protein
  misc_feature (1)..(113): Utility: Useful for delaying flowering time
  misc_feature (1)..(113): Utility: Useful for making larger plants
  misc_feature (1)..(113): Utility: Useful for making ornamental plants with modified flowers
  misc_feature (1)..(113): Utility: Useful for making ornamental plants with modified leaves
  misc_feature (1)..(113): Utility: Useful for making plants with increased biomass and foliage
  misc_feature (1)..(113): Utility: Useful for making smaller plants
MKVAAAFLLAVLGGNANPSAENIKDIIGAVGADVDGESIELLLKEVSGKDIAELIASGREKLASVPSGGGVAVSAAPSSGGGGAAAAAPAEKKEAKKEEKEESDDDMGFSLFE

SEQ ID NO: 5898 - protein, 139 aa, Brassica napus
  misc_feature (1)..(139): useful for making plants with modified plant phenotypes as described in USSN 12/139,269
  misc_feature (1)..(139): Ceres CLONE ID no. 953928
  misc_feature (1)..(139): Utility: Useful for delaying flowering time
  misc_feature (1)..(139): Utility: Useful for making larger plants
  misc_feature (1)..(139): Utility: Useful for making ornamental plants with modified flowers
  misc_feature (1)..(139): Utility: Useful for making ornamental plants with modified leaves
  misc_feature (1)..(139): Utility: Useful for making plants with increased biomass and foliage
  misc_feature (1)..(139): Utility: Useful for making smaller plants
FFHCLSSETLFSFPPPPARSPSTSAKMKVVAAFLLAVLSGKACPTSADIKVILNSVGCETEDSQIELLLKEVNGKDVAELIAVGREKLASVPSGGGGVAMASAPSAGGGGGAAPAEDKKEEKKEEKEESDDDMGFSLFE

SEQ ID NO: 5899 - protein, 114 aa, Glycine max
  misc_feature (1)..(114): useful for making plants with modified plant phenotypes as described in USSN 12/139,269
  misc_feature (1)..(114): Ceres CLONE ID no. 524682
  misc_feature (1)..(114): Utility: Useful for delaying flowering time
  misc_feature (1)..(114): Utility: Useful for making larger plants
  misc_feature (1)..(114): Utility: Useful for making ornamental plants with modified flowers
  misc_feature (1)..(114): Utility: Useful for making ornamental plants with modified leaves
  misc_feature (1)..(114): Utility: Useful for making plants with increased biomass and foliage
  misc_feature (1)..(114): Utility: Useful for making smaller plants
MKVVAAYLLAVLGGNNSPSADVIKEILGSVGVEADEDRIESFLSEVKGKDIVELIAAGREKLATVPSGCGGAVAVAAAPGGGAAAAAPAAEAKKEEKVEEKEESDDDMGFSLFD

SEQ ID NO: 5900 - protein, 114 aa, Brassica napus
  misc_feature (1)..(114): useful for making plants with modified plant phenotypes as described in USSN 12/139,269
  misc_feature (1)..(114): Ceres CLONE ID no. 949174
  misc_feature (1)..(114): Utility: Useful for delaying flowering time
  misc_feature (1)..(114): Utility: Useful for making larger plants
  misc_feature (1)..(114): Utility: Useful for making ornamental plants with modified flowers
  misc_feature (1)..(114): Utility: Useful for making ornamental plants with modified leaves
  misc_feature (1)..(114): Utility: Useful for making plants with increased biomass and foliage
  misc_feature (1)..(114): Utility: Useful for making smaller plants
MKVVAAFLLAVLSGKASPTSADIKDILGSVGAETEDAQIELLLKEVKGKDCAELIALGREKLASVPCGGGGVAMASAPSAGGGGGAAPAEEAKKEEKKEEKEESDDDMGFSLFE

SEQ ID NO: 5901 - protein, 114 aa, Brassica napus
  misc_feature (1)..(114): useful for making plants with modified plant phenotypes as described in USSN 12/139,269
  misc_feature (1)..(114): Ceres CLONE ID no. 1299820
  misc_feature (1)..(114): Utility: Useful for delaying flowering time
  misc_feature (1)..(114): Utility: Useful for making larger plants
  misc_feature (1)..(114): Utility: Useful for making ornamental plants with modified flowers
  misc_feature (1)..(114): Utility: Useful for making ornamental plants with modified leaves
  misc_feature (1)..(114): Utility: Useful for making plants with increased biomass and foliage
  misc_feature (1)..(114): Utility: Useful for making smaller plants
MKVVAAFLLAVLSGKASPTSADIKDILGSVGAETEDAQIEILLKEVKGKDCAELIAVGREKLASVPCGGGGVAMASAPSAGGGGGAAPAAEAKKEEKKEEKEESDDDMGFSLFE

SEQ ID NO: 5902 - protein, 114 aa, Brassica napus
  misc_feature (1)..(114): useful for making plants with modified plant phenotypes as described in USSN 12/139,269
  misc_feature (1)..(114): Public GI no. 42565379
  misc_feature (1)..(114): Utility: Useful for delaying flowering time
  misc_feature (1)..(114): Utility: Useful for making larger plants
  misc_feature (1)..(114): Utility: Useful for making ornamental plants with modified flowers
  misc_feature (1)..(114): Utility: Useful for making ornamental plants with modified leaves
  misc_feature (1)..(114): Utility: Useful for making plants with increased biomass and foliage
  misc_feature (1)..(114): Utility: Useful for making smaller plants
MKVVAAYLLAVLGGNTTPSAEVIKDILGSVGADAEDDRIELLLSEVKGKDITELIASGREKFASVPSGGAAIAVSAPAAGGGAAPAAAAAETKKEEKVEEKEESDEDMGFSLFD

SEQ ID NO: 5903 - protein, 138 aa, Brassica napus
  misc_feature (1)..(138): useful for making plants with modified plant phenotypes as described in USSN 12/139,269
  misc_feature (1)..(138): Ceres CLONE ID no. 1098019
  misc_feature (1)..(138): Utility: Useful for delaying flowering time
  misc_feature (1)..(138): Utility: Useful for making larger plants
  misc_feature (1)..(138): Utility: Useful for making ornamental plants with modified flowers
  misc_feature (1)..(138): Utility: Useful for making ornamental plants with modified leaves
  misc_feature (1)..(138): Utility: Useful for making plants with increased biomass and foliage
  misc_feature (1)..(138): Utility: Useful for making smaller plants
  misc_feature (4)..(4): Xaa is any aa, unknown or other
  misc_feature (10)..(10): Xaa is any aa, unknown or other
  misc_feature (28)..(28): Xaa is any aa, unknown or other
  misc_feature (29)..(29): Xaa is any aa, unknown or other
  misc_feature (72)..(72): Xaa is any aa, unknown or other
  misc_feature (81)..(81): Xaa is any aa, unknown or other
SFHXRLHKHXSFPPPPARSPSTSAKMKXXAAFLLAVLSGKACPTSADIKVILNSVGCETEDSQIELLLKEVXGKDVAELIXVGREKLASVPSGGGGVAMASAPSAGGGGGAAPAEAKKEEKKEEKEESDDDMGFSLFE

SEQ ID NO: 5904 - protein, 135 aa, Glycine max
  misc_feature (1)..(135): useful for making plants with modified plant phenotypes as described in USSN 12/139,269
  misc_feature (1)..(135): Ceres CLONE ID no. 691062
  misc_feature (1)..(135): Utility: Useful for delaying flowering time
  misc_feature (1)..(135): Utility: Useful for making larger plants
  misc_feature (1)..(135): Utility: Useful for making ornamental plants with modified flowers
  misc_feature (1)..(135): Utility: Useful for making ornamental plants with modified leaves
  misc_feature (1)..(135): Utility: Useful for making plants with increased biomass and foliage
  misc_feature (1)..(135): Utility: Useful for making smaller plants
TRPSKSPFVFFSFASSLSLRKMKVVAAYLLAVLGGNNSPSADVIKEILGSVGVEADEDRIESFLSEVKGKDIVELIAAGREKLASVPSGGGGAVAVAAAPGGGAAAAAPAAEAKKEEKVEEKEESDDDMGFSLSD

SEQ ID NO: 5905 - protein, 114 aa, Glycine max
  misc_feature (1)..(114): useful for making plants with modified plant phenotypes as described in USSN 12/139,269
  misc_feature (1)..(114): Public GI no. 47026878
  misc_feature (1)..(114): Utility: Useful for delaying flowering time
  misc_feature (1)..(114): Utility: Useful for making larger plants
  misc_feature (1)..(114): Utility: Useful for making ornamental plants with modified flowers
  misc_feature (1)..(114): Utility: Useful for making ornamental plants with modified leaves
  misc_feature (1)..(114): Utility: Useful for making plants with increased biomass and foliage
  misc_feature (1)..(114): Utility: Useful for making smaller plants
MKVVAAYLLAVLGGNTTPSAEVIKDILGSVGAEAEDDRILLLLSEVKGKDITELIASGREKFASVPSGGAAIAVSAPAAGGGAAPAAAAAETKKEEKVEEKEESDEDMGFSLFD

SEQ ID NO: 5906 - protein, 134 aa, Glycine max
  misc_feature (1)..(134): useful for making plants with modified plant phenotypes as described in USSN 12/139,269
  misc_feature (1)..(134): Ceres CLONE ID no. 1120463
  misc_feature (1)..(134): Utility: Useful for delaying flowering time
  misc_feature (1)..(134): Utility: Useful for making larger plants
  misc_feature (1)..(134): Utility: Useful for making ornamental plants with modified flowers
  misc_feature (1)..(134): Utility: Useful for making ornamental plants with modified leaves
  misc_feature (1)..(134): Utility: Useful for making plants with increased biomass and foliage
  misc_feature (1)..(134): Utility: Useful for making smaller plants
  misc_feature (134)..(134): Xaa is any aa, unknown or other
LPSPSPSLHSQFCHILTFRRKMKVIAAYLLAVLGGNAAPSADDLRDILGSVGADANDDNISNFLSEVKGKDIVELIASGREKLASVPSGGGAAVAVAAAPGGGPAAPAAAESKKEEKVEEKEESDDDMGFSLFX

SEQ ID NO: 5907 - protein, 113 aa, Glycine max
  misc_feature (1)..(113): useful for making plants with modified plant phenotypes as described in USSN 12/139,269
  misc_feature (1)..(113): Public GI no. 24473796
  misc_feature (1)..(113): Utility: Useful for delaying flowering time
  misc_feature (1)..(113): Utility: Useful for making larger plants
  misc_feature (1)..(113): Utility: Useful for making ornamental plants with modified flowers
  misc_feature (1)..(113): Utility: Useful for making ornamental plants with modified leaves
  misc_feature (1)..(113): Utility: Useful for making plants with increased biomass and foliage
  misc_feature (1)..(113): Utility: Useful for making smaller plants
MKVVAAYLLAVLGGNTTPSAEDLKDILGSVGAETDDDRIQLLLSEVKGKDITELIASGREKLASVPSGGGAVAVAAPGAGAGAAAPAAAEPKKEEKVEEKEDTDDDMGFSLFD

SEQ ID NO: 5908 - protein, 132 aa, Glycine max
  misc_feature (1)..(132): useful for making plants with modified plant phenotypes as described in USSN 12/139,269
  misc_feature (1)..(132): Ceres CLONE ID no. 708265
  misc_feature (1)..(132): Utility: Useful for delaying flowering time
  misc_feature (1)..(132): Utility: Useful for making larger plants
  misc_feature (1)..(132): Utility: Useful for making ornamental plants with modified flowers
  misc_feature (1)..(132): Utility: Useful for making ornamental plants with modified leaves
  misc_feature (1)..(132): Utility: Useful for making plants with increased biomass and foliage
  misc_feature (1)..(132): Utility: Useful for making smaller plants
TFTSLSDRSFCHTLTFRCKMKVIAAYLLAVLGGNAAPSADDLRTILGSVGADANDDNISNFLSEVKGKDIAELIAAGREKLASVPSGGGAAVSVAAAPGGGAAAPAAAESKKEEKVEEKEESDDDMGFSLFD

SEQ ID NO: 5909 - protein, 134 aa, Glycine max
  misc_feature (1)..(134): useful for making plants with modified plant phenotypes as described in USSN 12/139,269
  misc_feature (1)..(134): Ceres CLONE ID no. 475895
  misc_feature (1)..(134): Utility: Useful for delaying flowering time
  misc_feature (1)..(134): Utility: Useful for making larger plants
  misc_feature (1)..(134): Utility: Useful for making ornamental plants with modified flowers
  misc_feature (1)..(134): Utility: Useful for making ornamental plants with modified leaves
  misc_feature (1)..(134): Utility: Useful for making plants with increased biomass and foliage
  misc_feature (1)..(134): Utility: Useful for making smaller plants
SFTFTSLSDRSFCHTLTFRCKMKVIAAYLLAVLGGNAAPSADDLRTILGSVGADANDDNISNFLSEVKGKDIAELIAAGREKLASVPSGGGAAVSVAAAPGGGAAAPAAAESKKEEKVEEKEESDDDMGFSLFD

SEQ ID NO: 5910 - protein, 113 aa, Zea mays
  misc_feature (1)..(113): useful for making plants with modified plant phenotypes as described in USSN 12/139,269
  misc_feature (1)..(113): Ceres CLONE ID no. 415601
  misc_feature (1)..(113): Utility: Useful for delaying flowering time
  misc_feature (1)..(113): Utility: Useful for making larger plants
  misc_feature (1)..(113): Utility: Useful for making ornamental plants with modified flowers
  misc_feature (1)..(113): Utility: Useful for making ornamental plants with modified leaves
  misc_feature (1)..(113): Utility: Useful for making plants with increased biomass and foliage
  misc_feature (1)..(113): Utility: Useful for making smaller plants
MKFVAAYLLAVLAGNSSPSAEDLTSILESVGCEVDNEKMELLLSQLSGKDITELIAAGREKFASVPCGGGGVAVAAAAPAAGGGGAPAAEAKKEEKVEEKEESDDDMGFSLFD

SEQ ID NO: 5911 - protein, 114 aa, Zea mays
  misc_feature (1)..(114): useful for making plants with modified plant phenotypes as described in USSN 12/139,269
  misc_feature (1)..(114): Public GI no. 551267
  misc_feature (1)..(114): Utility: Useful for delaying flowering time
  misc_feature (1)..(114): Utility: Useful for making larger plants
  misc_feature (1)..(114): Utility: Useful for making ornamental plants with modified flowers
  misc_feature (1)..(114): Utility: Useful for making ornamental plants with modified leaves
  misc_feature (1)..(114): Utility: Useful for making plants with increased biomass and foliage
  misc_feature (1)..(114): Utility: Useful for making smaller plants
MKVIAAFLLALLGGNTSPTDEDLKSILASVGADADDDKIELLLSQVKGKDITELIASGRERLASVPSGGGVAVAAAAGGGGGDAPAAAAEEPKKEEKSEEESDEELGFSLFDDN

SEQ ID NO: 5912 - protein, 144 aa, Brassica napus
  misc_feature (1)..(144): useful for making plants with modified plant phenotypes as described in USSN 12/139,269
  misc_feature (1)..(144): Ceres CLONE ID no. 1117460
  misc_feature (1)..(144): Utility: Useful for delaying flowering time
  misc_feature (1)..(144): Utility: Useful for making larger plants
  misc_feature (1)..(144): Utility: Useful for making ornamental plants with modified flowers
  misc_feature (1)..(144): Utility: Useful for making ornamental plants with modified leaves
  misc_feature (1)..(144): Utility: Useful for making plants with increased biomass and foliage
  misc_feature (1)..(144): Utility: Useful for making smaller plants
  misc_feature (6)..(6): Xaa is any aa, unknown or other
  misc_feature (32)..(32): Xaa is any aa, unknown or other
  misc_feature (143)..(143): Xaa is any aa, unknown or other
INQIPXFACSSPSSQKTISFTPPSRSPPTKMXVVAAYLLAALSGKASPTSADIKQILGSVGCESEDSQIELLLKEVSGKDLCDLIATGREKLASVPSGGGGVAMASAPSAGGGGGGSPAAEAKKEEKKEEKEESDDDMGLSLXE

SEQ ID NO: 5913 - DNA, 512 bp, Arabidopsis thaliana
  misc_feature (1)..(512): useful for making plants with modified plant phenotypes as described in USSN 12/139,269
  misc_feature (1)..(512): Ceres CLONE ID no. 97480
  misc_feature (1)..(512): Also known as  Ceres CDNA ID no. 23380395
atcaactctattctgaaccaatttgatttccgttttttgcagatctttagggtttttgtttagggatttatcgaagactctgctctatcatgtctggaagaaaagaaacggttttagatttggccaagtttgtagataagggtgtgcaagttaagctcactggtggtagacaagtgactggaactcttaaaggctatgaccaattgcttaatcttgttcttgatgaagcagtcgagtttgttcgagatcatgatgatcctttgaagactacggatcagacaagacgccttggtttgattgtttgccgtggaaccggtgatgcttgtctcaccaaccgatggcaccgaagaaatcgctaacccgttcgttacagcagaggctgtctaaaagactttcttctcaaacaatatgtctctctattagtttaacttggcgatttagagagtattttatctaactctctggtgtgatgttggaaacatatatgttcaatttaaactatttggaacatc

SEQ ID NO: 5914 - protein, 89 aa, Arabidopsis thaliana
  misc_feature (1)..(89): useful for making plants with modified plant phenotypes as described in USSN 12/139,269
  misc_feature (9)..(75): Pfam Name: LSM; Pfam Description: LSM domain
  misc_feature (9)..(75): Pfam Name: LSM; Pfam Description: LSM domain
  misc_feature (1)..(89): Utility: Useful for delaying flowering time
  misc_feature (1)..(89): Utility: Useful for delaying senescence
MSGRKETVLDLAKFVDKGVQVKLTGGRQVTGTLKGYDQLLNLVLDEAVEFVRDHDDPLKTTDQTRRLGLIVCRGTGDACLTNRWHRRNR

SEQ ID NO: 5915 - protein, 99 aa, Brassica napus
  misc_feature (1)..(99): useful for making plants with modified plant phenotypes as described in USSN 12/139,269
  misc_feature (1)..(99): Ceres CLONE ID no. 1073419
  misc_feature (1)..(99): Utility: Useful for delaying flowering time
  misc_feature (1)..(99): Utility: Useful for delaying senescence
MSGRKETVLDLAKFVDKGVQVKLTGGRQVTGTLKGYDQLLNLVLDGALESVRDHDDPLKTTDQTRRLGLIVCRGTAVMLVSPTDGTEEIANPFNQPEAL

SEQ ID NO: 5916 - protein, 99 aa, Brassica napus
  misc_feature (1)..(99): useful for making plants with modified plant phenotypes as described in USSN 12/139,269
  misc_feature (1)..(99): Ceres CLONE ID no. 1064362
  misc_feature (1)..(99): Utility: Useful for delaying flowering time
  misc_feature (1)..(99): Utility: Useful for delaying senescence
MSGRKETVLDLAKFVDKGVQVKLTGGRQVTGTLKGYDQLLNLVLDGALESVRDHDDPLKTTDQTRRLGLIVCRGTAVMLVSPTDGTEEIANPFNQPEAV

SEQ ID NO: 5917 - protein, 86 aa, Brassica napus
  misc_feature (1)..(86): useful for making plants with modified plant phenotypes as described in USSN 12/139,269
  misc_feature (1)..(86): Ceres CLONE ID no. 1067161
  misc_feature (1)..(86): Utility: Useful for delaying flowering time
  misc_feature (1)..(86): Utility: Useful for delaying senescence
  misc_feature (21)..(21): Xaa is any aa, unknown or other
  misc_feature (43)..(43): Xaa is any aa, unknown or other
  misc_feature (75)..(75): Xaa is any aa, unknown or other
MSGRKETVLDLAKFVDKGVQXKLTGGRQVTGTLKGYDQLLNLXLDAAVESVRDHDDPLKTTDQTRRLGLIVCRGXAVMLVSPTDGT

SEQ ID NO: 5918 - protein, 98 aa, Brassica napus
  misc_feature (1)..(98): useful for making plants with modified plant phenotypes as described in USSN 12/139,269
  misc_feature (1)..(98): Public GI no. 50941651
  misc_feature (1)..(98): Utility: Useful for delaying flowering time
  misc_feature (1)..(98): Utility: Useful for delaying senescence
MSGRKETVLDLAKFVDKGVQVKLTGGRQVTGTLKGYDQLLNLVLDEAVEFEREQDDPLKLSGKTRQLGLIVCRGTAVMLVSPTDGTDEIANPFQSDGA

SEQ ID NO: 5919 - protein, 104 aa, Triticum aestivum
  misc_feature (1)..(104): useful for making plants with modified plant phenotypes as described in USSN 12/139,269
  misc_feature (1)..(104): Ceres CLONE ID no. 685838
  misc_feature (1)..(104): Utility: Useful for delaying flowering time
  misc_feature (1)..(104): Utility: Useful for delaying senescence
MSGRKETVLDLAKFVDKGIQVKLTGGRQVTGTLKGYDQLLNLVLDEAIEFEREQDDPLKLSTKTRQLGLIVCRGTAVMLVSPTEGTEEIKNPFQEADGEQTAHS

SEQ ID NO: 5920 - protein, 98 aa, Zea mays
  misc_feature (1)..(98): useful for making plants with modified plant phenotypes as described in USSN 12/139,269
  misc_feature (1)..(98): Ceres CLONE ID no. 462970
  misc_feature (1)..(98): Utility: Useful for delaying flowering time
  misc_feature (1)..(98): Utility: Useful for delaying senescence
MAGRKETALDLAKFVDKGVQVKLTGGRQVTGTLKGYDQLLNLVLDEAVEYEREQDDPLKLSGKTRQLGLIVCRGTAVMLVSPTDGTDEIANPFLAEGA

SEQ ID NO: 5921 - protein, 98 aa, Zea mays; identical to SEQ ID NO: 5920
  misc_feature (1)..(98): useful for making plants with modified plant phenotypes as described in USSN 12/139,269
  misc_feature (1)..(98): Ceres CLONE ID no. 393073
  misc_feature (1)..(98): Utility: Useful for delaying flowering time
  misc_feature (1)..(98): Utility: Useful for delaying senescence

SEQ ID NO: 5922 - protein, 100 aa, Triticum aestivum
  misc_feature (1)..(100): useful for making plants with modified plant phenotypes as described in USSN 12/139,269
  misc_feature (1)..(100): Ceres CLONE ID no. 606064
  misc_feature (1)..(100): Utility: Useful for delaying flowering time
  misc_feature (1)..(100): Utility: Useful for delaying senescence
MAGRKETALDLAKFVDKGVQVKLTGGRQVTGTLKGYDQLLNLVLDEAVESEREQDDPLKLSTKTRQLGLIVCRGTAVMLVSPTDGTDEIANPFLAAEGAS

SEQ ID NO: 5923 - protein, 100 aa, Triticum aestivum; identical to SEQ ID NO: 5922
  misc_feature (1)..(100): useful for making plants with modified plant phenotypes as described in USSN 12/139,269
  misc_feature (1)..(100): Ceres CLONE ID no. 1018838
  misc_feature (1)..(100): Utility: Useful for delaying flowering time
  misc_feature (1)..(100): Utility: Useful for delaying senescence

SEQ ID NO: 5924 - protein, 100 aa, Triticum aestivum
  misc_feature (1)..(100): useful for making plants with modified plant phenotypes as described in USSN 12/139,269
  misc_feature (1)..(100): Ceres CLONE ID no. 1031827
  misc_feature (1)..(100): Utility: Useful for delaying flowering time
  misc_feature (1)..(100): Utility: Useful for delaying senescence
  misc_feature (97)..(97): Xaa is any aa, unknown or other
MAGRKETALDLAKFVDKGVQVKLTGGRQVTGTLKGYDQLLNLVLDEAVESEREQDDPLKLSTKTRQLGLIVCRGTAVMLCLRLMEPTRLPTPSSQRXGAS

SEQ ID NO: 5925 - protein, 100 aa, Zea mays; identical to SEQ ID NO: 5922
  misc_feature (1)..(100): useful for making plants with modified plant phenotypes as described in USSN 12/139,269
  misc_feature (1)..(100): Ceres CLONE ID no. 1502051
  misc_feature (1)..(100): Utility: Useful for delaying flowering time
  misc_feature (1)..(100): Utility: Useful for delaying senescence

SEQ ID NO: 5926 - protein, 73 aa, Triticum aestivum
  misc_feature (1)..(73): useful for making plants with modified plant phenotypes as described in USSN 12/139,269
  misc_feature (1)..(73): Ceres CLONE ID no. 1054195
  misc_feature (1)..(73): Utility: Useful for delaying flowering time
  misc_feature (1)..(73): Utility: Useful for delaying senescence
  misc_feature (70)..(70): Xaa is any aa, unknown or other
MAGRKETALDLAKFVDKGVQVKLTGGRQVTGTLKGYDQLLNLVLDEAVESEREQDDPLKLSTKTRQLGLXCVQ

SEQ ID NO: 5927 - DNA, 1359 bp, Arabidopsis thaliana
  misc_feature (1)..(1359): useful for making plants with modified plant phenotypes as described in USSN 12/139,269
  misc_feature (1)..(1359): Ceres CLONE ID no. 97958
  misc_feature (1)..(1359): Also known as  Ceres CDNA ID no. 23363449
atactaaatcatcaccccaacactacaaagaagaaacacactctatctctctgtctcaatacatatttcctcacttctgatcagtgtgatcacgtagagtgccttgaaggagaagaaggaaacaaaaagaaataaaaatgggataccttatagaagaaactttaagctctaactctaaaaccccaattgttatcgatgatgataacgagttgggtttgatggccgtgagactagccaatgctgctgcctttccgatggttctcaaagccgccctcgagctcggtgtctttgacactctctatgctgaagcctctcgcagcgactcgttcctttcaccatcagaaatagcgagtaagctaccaactacacctcgtaaccctgaggctccggttttattggaccgtatgcttcgtctactcgctagctattctgtggtcaagtgtggtaaggtctcataaggaaagggtgagagggtctacagagccgagccaatttgcaggtttttcttgaaggataacattcaagatattggatcccttgcttctcaagtcattgtcaatttcgatagcgtcttcctcaatacttgggcacaattgaaagacgtggttctagaaggaggagatgcatttggccgcgcacatggtggtatgaagctctttgactatatgggtacagatgagagattcagcaaactatttaaccagaccggttttaccattgcggtggtgaagaaggctcttgaagtttaccaaggcttcaaagatgtggatgtgttggttgatgtgggaggtggagttggtaacactcttggtgttgtaacatctaagtatcccaatattaagggtatcaattttgatctaacttgcgccttggcacaagcaccctcttatcccggtgtggaacatgttgctggagatatgtttgtggatattccaaccggagatgctatgatcttgaaacgtatacttcatgattggaccgacgaagactgtgtgaagattcttaagaattgttggaaatcacttccagaaaacggtaaagtggttgtcatagaattagtcactcctgatgaggcagagaatggagacatcaacgcaaacattgcctttgacatggacatgttaatgttcacacaatgttccggaggaaaagagagatcaagagctgagtttgaagctttggctgcagcttctggctttacccattgcaagttcgtttgccaagcttatcactgctggattattgagttctgtaaataaaatgtgtgaaatgtaaaacaaaatcgtcgttaattatttattttcatctttgttgtcattctttcttgatatctttctcgtcgagtaataaaagtgtttt

SEQ ID NO: 5928 - protein, 203 aa, Arabidopsis thaliana
  misc_feature (1)..(203): useful for making plants with modified plant phenotypes as described in USSN 12/139,269
  misc_feature (2)..(180): Pfam Name: Methyltransf_2; Pfam Description: O-methyltransferase
  misc_feature (1)..(203): Utility: Useful for delaying flowering time
  misc_feature (1)..(203): Utility: Useful for delaying senescence
  misc_feature (1)..(203): Utility: Useful for increasing seed/fruit yield or modifying fruit content
  misc_feature (1)..(203): Utility: Useful for making plants sterile and for genetic confinement
  misc_feature (1)..(203): Utility: Useful for making smaller plants
  misc_feature (1)..(203): Utility: Useful for making taller plants and plants with longer inflorescences
MKLFDYMGTDERFSKLFNQTGFTIAVVKKALEVYQGFKDVDVLVDVGGGVGNTLGVVTSKYPNIKGINFDLTCALAQAPSYPGVEHVAGDMFVDIPTGDAMILKRILHDWTDEDCVKILKNCWKSLPENGKVVVIELVTPDEAENGDINANIAFDMDMLMFTQCSGGKERSRAEFEALAAASGFTHCKFVCQAYHCWIIEFCK

SEQ ID NO: 5929 - protein, 197 aa, Arabidopsis thaliana
  misc_feature (1)..(197): useful for making plants with modified plant phenotypes as described in USSN 12/139,269
  misc_feature (1)..(197): Ceres CLONE ID no. 101583
  misc_feature (1)..(197): Utility: Useful for delaying flowering time
  misc_feature (1)..(197): Utility: Useful for delaying senescence
  misc_feature (1)..(197): Utility: Useful for increasing seed/fruit yield or modifying fruit content
  misc_feature (1)..(197): Utility: Useful for making plants sterile and for genetic confinement
  misc_feature (1)..(197): Utility: Useful for making smaller plants
  misc_feature (1)..(197): Utility: Useful for making taller plants and plants with longer inflorescences
MGTDERFSKLFNQTGFTIAVVKKALEVYQGFKDVNVLVDVGGGVGNTLGVVTSKYPNIKGINFDLTCALAQAPSYPGVEHVAGDMFVDIPTGDAMILKRILHDWTDEDCVKILNNCWKSLPENGKVVVIELVTPDEAENGDINANIAFDMDMLMFTQCSGGKERSRAEFEALAAASGFTHCKFVCQAYHCWIIEFCK

SEQ ID NO: 5930 - protein, 346 aa, Arabidopsis thaliana
  misc_feature (1)..(346): useful for making plants with modified plant phenotypes as described in USSN 12/139,269
  misc_feature (1)..(346): Ceres CLONE ID no. 1347792
  misc_feature (1)..(346): Utility: Useful for delaying flowering time
  misc_feature (1)..(346): Utility: Useful for delaying senescence
  misc_feature (1)..(346): Utility: Useful for increasing seed/fruit yield or modifying fruit content
  misc_feature (1)..(346): Utility: Useful for making plants sterile and for genetic confinement
  misc_feature (1)..(346): Utility: Useful for making smaller plants
  misc_feature (1)..(346): Utility: Useful for making taller plants and plants with longer inflorescences
MAVRLANAAAFPMVLKAALELGVFDTLYAAASRTDSFLSPYEIASKLPTTPRNPEAPVLLDRMLRLLASYSMVKCGKALSGKGERVYRAEPICRFFLKDNIQDIGSLASQVIVNFDSVFLNTWAQLKDVVLEGGDAFGRAHGGMKLFDYMGTDERFSKLFNQTGFTIAVVKKALEVYEGFKGVKVLVDVGGGVGNTLGVVTSKYPNIKGINFDLTCALAQAPSYPGVEHVAGDMFVDVPTGDAMILKRILHDWTDEDCVKILKNCWKSLPENGKVVVIELVTPDEAENGDINANIAFDMDMLMFTQCSGGKERSRAEFEALAAASGFTHCKFVCQAYHCWIIEFCK

SEQ ID NO: 5931 - protein, 373 aa, Arabidopsis thaliana
  misc_feature (1)..(373): useful for making plants with modified plant phenotypes as described in USSN 12/139,269
  misc_feature (1)..(373): Public GI no. 23506107
  misc_feature (1)..(373): Utility: Useful for delaying flowering time
  misc_feature (1)..(373): Utility: Useful for delaying senescence
  misc_feature (1)..(373): Utility: Useful for increasing seed/fruit yield or modifying fruit content
  misc_feature (1)..(373): Utility: Useful for making plants sterile and for genetic confinement
  misc_feature (1)..(373): Utility: Useful for making smaller plants
  misc_feature (1)..(373): Utility: Useful for making taller plants and plants with longer inflorescences
MGYLFQETLSSNPKTPIVVDDDNELGLMAVRLANAAAFPMVLKAALELGVFDTLYAAASRTDSFLSPYEIASKLPTTPRNPEAPVLLDRMLRLLASYSMVKCGKALSGKGERVYRAEPICRFFLKDNIQDIGSLASQVIVNFDSVFLNTWAQLKDVVLEGGDAFGRAHGGMKLFDYMGTDERFSKLFNQTGFTIAVVKKALEVYEGFKGVKVLVDVGGGVGNTLGVVTSKYPNIKGINFDLTCALAQAPSYPGVEHVAGDMFVDVPTGDAMILKRILHDWTDEDCVKILKNCWKSLPENGKVVVIELVTPDEAENGDINANIAFDMDMLMFTQCSGGKERSRAEFEALAAASGFTHCKFVCQAYHCWIIEFCK

SEQ ID NO: 5932 - protein, 373 aa, Arabidopsis thaliana
  misc_feature (1)..(373): useful for making plants with modified plant phenotypes as described in USSN 12/139,269
  misc_feature (1)..(373): Public GI no. 12744973
  misc_feature (1)..(373): Utility: Useful for delaying flowering time
  misc_feature (1)..(373): Utility: Useful for delaying senescence
  misc_feature (1)..(373): Utility: Useful for increasing seed/fruit yield or modifying fruit content
  misc_feature (1)..(373): Utility: Useful for making plants sterile and for genetic confinement
  misc_feature (1)..(373): Utility: Useful for making smaller plants
  misc_feature (1)..(373): Utility: Useful for making taller plants and plants with longer inflorescences
MGYLFEETLSSNPKTPIVVDDDNELGLMAVRLANAAAFPMVLKASLELGVFDTLYAEASRTDSFLSPSEIASKLPTTPRNPGAPVLLDRMLRLLASYSMVKCEKVSVGKGERVYRAEPICRFFLKNNIQDIGSLASQVIVNFDSVFLNTWAQLKDVVLEGGDAFGRAHGGMKLFDYMGTDERFSKLFNQTGFTIAVVKKALEVYQGFKGVNVLVDVGGGVGNTLGVVTSKYPNIKGINFDLTCALAQAPSYPGVEHVAGDMFVDVPTGDAMILKRILHDWTDEDCVKILKNCWKSLPENGKVVVIELVTPDEAENGDINANIAFDMDMLMFTQCSGGKERSRAEFEALAAASCFTHCKFVCQAYHCWIIEFCK

SEQ ID NO: 5933 - protein, 373 aa, Arabidopsis thaliana
  misc_feature (1)..(373): useful for making plants with modified plant phenotypes as described in USSN 12/139,269
  misc_feature (1)..(373): Ceres CLONE ID no. 12023
  misc_feature (1)..(373): Utility: Useful for delaying flowering time
  misc_feature (1)..(373): Utility: Useful for delaying senescence
  misc_feature (1)..(373): Utility: Useful for increasing seed/fruit yield or modifying fruit content
  misc_feature (1)..(373): Utility: Useful for making plants sterile and for genetic confinement
  misc_feature (1)..(373): Utility: Useful for making smaller plants
  misc_feature (1)..(373): Utility: Useful for making taller plants and plants with longer inflorescences
MGYLFEETLSSNPKTPIVVDDDNELGLMAVRLANAAAFPMVLKASLELGVFDTLYAEASRTDSFLSPSEIASKLPTTPRNPGAPVLLDRMLRLLASYSMVKCEKVSVGKGERVYRAEPICRFFLKNNIQDIGSLASQVIVNFDTVFLNTWAQLKDVVLEGGDAFGRAHGGMKLFDYMGTDERFSKLFNQTGFTIAVVKKALEVYEGFKGVNVLVDVGGGVGNTLGVVTSKYPNIKGINFDLTCALAQAPSYPGVEHVAGDMFVDVPTGDAMILKRILHDWTDEDCVKILKNCWKSLPKNGKVVVIELVTPDEAENGDINANIAFDMDMLMFTQCSGGKERSRAEFEALAAASGFTHCKFVCQAYHCWIIEFCK

SEQ ID NO: 5934 - protein, 373 aa, Arabidopsis thaliana
  misc_feature (1)..(373): useful for making plants with modified plant phenotypes as described in USSN 12/139,269
  misc_feature (1)..(373): Public GI no. 62320460
  misc_feature (1)..(373): Utility: Useful for delaying flowering time
  misc_feature (1)..(373): Utility: Useful for delaying senescence
  misc_feature (1)..(373): Utility: Useful for increasing seed/fruit yield or modifying fruit content
  misc_feature (1)..(373): Utility: Useful for making plants sterile and for genetic confinement
  misc_feature (1)..(373): Utility: Useful for making smaller plants
  misc_feature (1)..(373): Utility: Useful for making taller plants and plants with longer inflorescences
MGYLFEETLSSNPKTPIVVDDDNELGLMAVRLANAAAFPMVLKASLELGVFDTLYAEASRTDSFLSPSEIASKLPTTPRNPGAPVLLDRMLRLLASYSMVKCEKVSVGKGERVYRAEPICRFFLKNNIQDIGSLASQVIVNFDSVFLNTWAQLKDVVLEGGDAFGRAHGGMKLFDYMGTDERFSKLFNQTGFTIAVVKKALEVYQGFKGVNVLVDVGGGVGNTLGVVTSKYPNIKGINFDLTCALAQAPSYPGVEHVAGDMFVDVPTGDAMILKRILHDWTDEDCVKILKNCWKSLPENGKVVVIELVIPDEAENGDINANIAFDMDMLMFTQCSGGKERSRAEFEALAAASCFTHCKFVCQAYHCWIIEFCK

SEQ ID NO: 5935 - protein, 373 aa, Arabidopsis thaliana
  misc_feature (1)..(373): useful for making plants with modified plant phenotypes as described in USSN 12/139,269
  misc_feature (1)..(373): Public GI no. 15218138
  misc_feature (1)..(373): Utility: Useful for delaying flowering time
  misc_feature (1)..(373): Utility: Useful for delaying senescence
  misc_feature (1)..(373): Utility: Useful for increasing seed/fruit yield or modifying fruit content
  misc_feature (1)..(373): Utility: Useful for making plants sterile and for genetic confinement
  misc_feature (1)..(373): Utility: Useful for making smaller plants
  misc_feature (1)..(373): Utility: Useful for making taller plants and plants with longer inflorescences
MGYLLEETLSSNSKTPIVIDDDNELGLMAVRLANAAAFPMVLKAALELGVFDTLYAEASRSDSFLSPSEIASKLPTTPRNPEAPVLLDRMLRLLASYSVVKCGKVSEGKGERVYRAEPICRFFLKDNIQDIGSLASQVIVNFDSVFLNTWAQLKDVVLEGGDAFGRAHGGMKLFDYMGTDERFSKLFNQTGFTIAVVKKALEVYQGFKGVNVLVDVGGGVGNTLGVVASKYPNIKGINFDLTCALAQAPSYPGVEHVAGDMFVDVPTGDAMILKRILHDWTDEDCVKILKNCWKSLPESGKVVVIELVTPDEAENGDINANIAFDMDMLMFTQCSGGKERSRAEFEALAAASGFTHCKFVCQAYHCWIIEFCK

SEQ ID NO: 5936 - protein, 373 aa, Arabidopsis thaliana
  misc_feature (1)..(373): useful for making plants with modified plant phenotypes as described in USSN 12/139,269
  misc_feature (1)..(373): Public GI no. 28973283
  misc_feature (1)..(373): Utility: Useful for delaying flowering time
  misc_feature (1)..(373): Utility: Useful for delaying senescence
  misc_feature (1)..(373): Utility: Useful for increasing seed/fruit yield or modifying fruit content
  misc_feature (1)..(373): Utility: Useful for making plants sterile and for genetic confinement
  misc_feature (1)..(373): Utility: Useful for making smaller plants
  misc_feature (1)..(373): Utility: Useful for making taller plants and plants with longer inflorescences
MGYLFEETLSSNPKTPIVVDDDNELGLMAVRLANAAAFPMVLKASLELGVFDTLYAEASRTDSFLSPSEIASKLPTTPRNPGAPVLLDRMLRLLASYSMVKCEKVSVGKEQRVYRAEPICRFFLKNNIQDIGSLASQVIVNFDSVFLNTWAQLKDVVLEGGDAFGRAHGGMKLFDYMGTDERFSKLFNQTGFTIAVVKKALEVYQGFKGVNVLVDVGGGVGNTLGVVTSKYPNIKGINFDLTCALAQAPTYPGVEHVAGDMFVDVPTGNAMILKRILHDWTDEDCVKILKNCWKSLPQNGKVVVIELVTPDEAENGDINANIAFDMDMLMFTQCSGGKERSRAEFEALAAASGFSHCQFVCQAYHCWIIEFCK

SEQ ID NO: 5937 - protein, 371 aa, Arabidopsis thaliana
  misc_feature (1)..(371): useful for making plants with modified plant phenotypes as described in USSN 12/139,269
  misc_feature (1)..(371): Public GI no. 47232556
  misc_feature (1)..(371): Utility: Useful for delaying flowering time
  misc_feature (1)..(371): Utility: Useful for delaying senescence
  misc_feature (1)..(371): Utility: Useful for increasing seed/fruit yield or modifying fruit content
  misc_feature (1)..(371): Utility: Useful for making plants sterile and for genetic confinement
  misc_feature (1)..(371): Utility: Useful for making smaller plants
  misc_feature (1)..(371): Utility: Useful for making taller plants and plants with longer inflorescences
MRSTSPQTIDSTPMSHPQQEEEEELGKQAIRLANVVILPMVLKSALELNVIDIIWGAGDGESLSPSDIAAQLPTKNSNAPAVLDRMLRLLASHSILKCSARTGSDGQVERLYSAGPICKFLVKDQNGGTRSVGPLFLLHHDKVFMEGWFHLNDAILEGGIPFNRAYGMTAFEYPETDERFNRVFNQAMSNHTTLILKKILDVYRGFEGINVLVDVGGGIGVTLNLITNKYPHIKGINFDLPHVLADAPSYPGVEHVGGDMFKSVPQGDAIFMKWILHDWSDEHCLTLLKNCCKSLPSSGKVIFVESILPEVPDSTVTSNIVCEQDLLMFTQNPGGKERTKKEYEALALKSGFSRLEVVCSAYNSWVMEFHK

SEQ ID NO: 5938 - protein, 375 aa, Triticum aestivum
  misc_feature (1)..(375): useful for making plants with modified plant phenotypes as described in USSN 12/139,269
  misc_feature (1)..(375): Ceres CLONE ID no. 632026
  misc_feature (1)..(375): Utility: Useful for delaying flowering time
  misc_feature (1)..(375): Utility: Useful for delaying senescence
  misc_feature (1)..(375): Utility: Useful for increasing seed/fruit yield or modifying fruit content
  misc_feature (1)..(375): Utility: Useful for making plants sterile and for genetic confinement
  misc_feature (1)..(375): Utility: Useful for making smaller plants
  misc_feature (1)..(375): Utility: Useful for making taller plants and plants with longer inflorescences
  misc_feature (113)..(113): Xaa is any aa, unknown or other
  misc_feature (114)..(114): Xaa is any aa, unknown or other
  misc_feature (115)..(115): Xaa is any aa, unknown or other
  misc_feature (120)..(120): Xaa is any aa, unknown or other
  misc_feature (121)..(121): Xaa is any aa, unknown or other
  misc_feature (226)..(226): Xaa is any aa, unknown or other
QNKRVLVHQPQQTRWRQRQLMGSMAAEMTAVEEEACIYAMQLSSTAVLPLTLKNAIELGMLEVLMGAGGKMLSPSEVAARLPPTTTNPDAPAMVDRMLHLLASLQGGVVAKVXXXTHAPXXTGPTPVCKWFTPNQDGISMAPLLLLTNDKVPMESLYHLKDAVLDGGLPFHKAHGMTMYEYTKTDARLNHVFNEAMKSYTTIVTGKLVELYTGFHDVATLVDVGGXVGATIRAVTSKYPHIKGINFDLPHVIAEAPQSPGVEHVAGDMFKNVPSGDAIVLKWILHNWTDEHCTTLLRNCYNALPAHGKVVVVEGILPVEPEATSRGQQASLSDMIMLTHTAGGKERNQREFEQLAKAAGFTGVKTAYIYSNTLGH

SEQ ID NO: 5939 - protein, 146 aa, Brassica napus
  misc_feature (1)..(146): useful for making plants with modified plant phenotypes as described in USSN 12/139,269
  misc_feature (1)..(146): Ceres CLONE ID no. 974547
  misc_feature (1)..(146): Utility: Useful for delaying flowering time
  misc_feature (1)..(146): Utility: Useful for delaying senescence
  misc_feature (1)..(146): Utility: Useful for increasing seed/fruit yield or modifying fruit content
  misc_feature (1)..(146): Utility: Useful for making plants sterile and for genetic confinement
  misc_feature (1)..(146): Utility: Useful for making smaller plants
  misc_feature (1)..(146): Utility: Useful for making taller plants and plants with longer inflorescences
MSNHSTITMKKILETYNGFEGLVSLVDVGGGIGATLKMIVSKYPNLKGINFDLPHVIEDAPSHPGVEHVGGDMFVSVPKGDAIFMKWICHDWSDEHCLKFLKNCYEALPENGKVILAECILPETLDSSLSTKQVVNVDCIMLALNP

SEQ ID NO: 5940 - protein, 361 aa, Brassica napus
  misc_feature (1)..(361): useful for making plants with modified plant phenotypes as described in USSN 12/139,269
  misc_feature (1)..(361): Public GI no. 5031494
  misc_feature (1)..(361): Utility: Useful for delaying flowering time
  misc_feature (1)..(361): Utility: Useful for delaying senescence
  misc_feature (1)..(361): Utility: Useful for increasing seed/fruit yield or modifying fruit content
  misc_feature (1)..(361): Utility: Useful for making plants sterile and for genetic confinement
  misc_feature (1)..(361): Utility: Useful for making smaller plants
  misc_feature (1)..(361): Utility: Useful for making taller plants and plants with longer inflorescences
MSSTANNPQINSDEEENFLFAMQLASASVLPMVLKSAIELDLLELIKKAGAGAFVSPAELAAQLLTTNAEAHVMLDRILRLLTSYAILECRLKTLPDGGVQRLYGLAPVCKFLTKNEDGVSMAPLALMNQDKVLMESWYHLKDAVLDGGIPFNKAYGMTAFEYHGTDPRFNKVFNQGMSNHSTITMKKILETYTGFDGLKTVVDVGGGTGATLNMIISKYPSIKGINFDLPHVVEDAPSYPGVEHVGGDMFVSVPKGDAIFMKWICHDWSDAHCVKFLKKCYEALPENGKVILAECVLPEAPDTGLATKNVVHIDVIMLAHNPGGKERTEKEFQVLAKASGFKQFNKVCCAYNSWIMELLK

SEQ ID NO: 5941 - protein, 361 aa, Brassica napus
  misc_feature (1)..(361): useful for making plants with modified plant phenotypes as described in USSN 12/139,269
  misc_feature (1)..(361): Public GI no. 5031492
  misc_feature (1)..(361): Utility: Useful for delaying flowering time
  misc_feature (1)..(361): Utility: Useful for delaying senescence
  misc_feature (1)..(361): Utility: Useful for increasing seed/fruit yield or modifying fruit content
  misc_feature (1)..(361): Utility: Useful for making plants sterile and for genetic confinement
  misc_feature (1)..(361): Utility: Useful for making smaller plants
  misc_feature (1)..(361): Utility: Useful for making taller plants and plants with longer inflorescences
MGSATNTPQINSDEEENFLFAMQLASASVLPMVLKSAIELDLLELIKKSGAGAFVSPVDLAAQLPTTNPDAHVMLDRILRLLTSYAILECRLKTLPDGGVERLYGLAPVCKFLTKNEDGVSMAPLTLMNQDKVLMESWYHLSDAVVDGGIPFNKAYGMTAFEYHGTDPRFNKVFNQGMSNHSTITMKKILETYTGFDGLKTVVDVGGGTGATLNMIVSKYPSIKGINFDLPHVIEDAPSYPGVEHVGGDMFVSVPKGDAIFMKWICHDWSDEHCVKFLKNCYDALPQNGKVILAECVLPEAPDTGLATKNVVHIDVIMLAHNPGGKERTEKEFQGLAKAAGFKQFNKACCAYNTWIMELLK

SEQ ID NO: 5942 - protein, 360 aa, Glycine max
  misc_feature (1)..(360): useful for making plants with modified plant phenotypes as described in USSN 12/139,269
  misc_feature (1)..(360): Ceres CLONE ID no. 561287
  misc_feature (1)..(360): Utility: Useful for delaying flowering time
  misc_feature (1)..(360): Utility: Useful for delaying senescence
  misc_feature (1)..(360): Utility: Useful for increasing seed/fruit yield or modifying fruit content
  misc_feature (1)..(360): Utility: Useful for making plants sterile and for genetic confinement
  misc_feature (1)..(360): Utility: Useful for making smaller plants
  misc_feature (1)..(360): Utility: Useful for making taller plants and plants with longer inflorescences
MHLKQVEEEQDGILFAMNMMSTMVYPFVVRTAIELGIFDIIAKAGEGAKLSAEEIIEQLGTKNPEAPTMLDRLLRLLASHSMLSSSLDTEDLQHGQNSPKRLYSLTYASKYFVTDADGVSFGATLNLLLDKVFLESWTELKGAILEGGVAFNRVHSMHSFEYPAVDPRFNDVFNKAMFNLTTIVMKRVLEFYEGFKNINRLVDVGGGLGINLNLITSKYPHVQGVNFDLPHVIEHAPTYPGIEHVGGDMFESVPNGDAIFMKWILHDWSDEQCLKLLKNCHKAIPSDGKVIVVDLILPILPESTVTAKSGFQADLLMMTQNSGGKERTQHEFMELALSSGFSGIKIVCSVSGFWVMEFYK

SEQ ID NO: 5943 - protein, 362 aa, Glycine max
  misc_feature (1)..(362): useful for making plants with modified plant phenotypes as described in USSN 12/139,269
  misc_feature (1)..(362): Public GI no. 4808524
  misc_feature (1)..(362): Utility: Useful for delaying flowering time
  misc_feature (1)..(362): Utility: Useful for delaying senescence
  misc_feature (1)..(362): Utility: Useful for increasing seed/fruit yield or modifying fruit content
  misc_feature (1)..(362): Utility: Useful for making plants sterile and for genetic confinement
  misc_feature (1)..(362): Utility: Useful for making smaller plants
  misc_feature (1)..(362): Utility: Useful for making taller plants and plants with longer inflorescences
MGSTQKNHNLTPEEEEEACLHAMQLASASVLPMVLKAAIELSVLEIIAKAGQGAYVAPTEIASQLSTSNSQAPIILDRILRLLASYKVLTCNLRTLEDGGVERLYGLAPVCKFLVKNEDGVSIAPLVLMNQDKVLMESWYHLKDAVLDGGIPFNKAYGMTAFEYHGTDPRFNKVFNRGMADHSTITMKKLLELYKGFEGLKSVVDVGGGTGATINMIVTKHPTIKGINFDLPHVIDDAPAYPGVEHIGGDMFVSVPKGDAIFMKWILHDWSDEHSVKFLKNCYESIPADGKVIIVESILPVYPETNLASNACFQLDNIMLAHNPGGKERTEKDFEALSAKAGFTGFKIVCGAFGSWVMEFCK

SEQ ID NO: 5944 - protein, 365 aa, Glycine max
  misc_feature (1)..(365): useful for making plants with modified plant phenotypes as described in USSN 12/139,269
  misc_feature (1)..(365): Public GI no. 57157826
  misc_feature (1)..(365): Utility: Useful for delaying flowering time
  misc_feature (1)..(365): Utility: Useful for delaying senescence
  misc_feature (1)..(365): Utility: Useful for increasing seed/fruit yield or modifying fruit content
  misc_feature (1)..(365): Utility: Useful for making plants sterile and for genetic confinement
  misc_feature (1)..(365): Utility: Useful for making smaller plants
  misc_feature (1)..(365): Utility: Useful for making taller plants and plants with longer inflorescences
MDSTPVIQIPTPYPFSDEEACLYAMQLRSFSVLPMTLKAAIELDLLEIIAKAGPGAYLSPAEISSQLPTENPEAPAMIDRMLRLLACYSVVSCRVDAAGDDGKPRRRYGAERVVKYLTKNEDGVSMAALTLMNQDKVFMESWYHLKDAVLEGGIPFKKAFGMSPFEYQGTDPRFNKVFNEGMRNHSAFIMKKILETYQGFDSVKLLVDVGGGLGGTMKAIVTKYPHIEGINFDLSHVISEAPPIPGVKHVGGDMFESVPSGDAIFMKWILHDWSDAHCLKLLSNCWKALPEDGKVIVMEGILPTIPEPTSAAQGVVHIDLVMMAHNPGGKERTKAEFESLARDAGFSGSKALCSYANCWILEFYK

SEQ ID NO: 5945 - DNA, 713 bp, Arabidopsis thaliana; identical to SEQ ID NO: 409
  misc_feature (1)..(713): useful for making plants with modified plant phenotypes as described in USSN 12/139,269
  misc_feature (1)..(713): Ceres CLONE ID no. 98855
  misc_feature (1)..(713): Also known as  Ceres CDNA ID no. 23360333

SEQ ID NO: 5946 - protein, 141 aa, Arabidopsis thaliana; identical to SEQ ID NO: 410
  misc_feature (1)..(141): useful for making plants with modified plant phenotypes as described in USSN 12/139,269
  misc_feature (10)..(81): Pfam Name: RRM_1; Pfam Description: RNA recognition motif. (a.k.a. RRM, RBD, or RNP domain)
  misc_feature (1)..(141): Utility: Useful for delaying flowering time

SEQ ID NO: 5947 - protein, 134 aa, Brassica napus
  misc_feature (1)..(134): useful for making plants with modified plant phenotypes as described in USSN 12/139,269
  misc_feature (1)..(134): Ceres CLONE ID no. 977670
  misc_feature (1)..(134): Utility: Useful for delaying flowering time
MASPDVEYRCFVGGLAWATDDRALETAFSQYGDVLDSKIINDRETGRSRGFGFVTFKDEKSMKDAIEGMNGQDLDGRSITVNEAQSRGGGGGGGRGGGGGGYRSGGGGGYGGGGGGYGGGGGRREGGYSGGGGG

SEQ ID NO: 5948 - protein, 136 aa, Brassica napus
  misc_feature (1)..(136): useful for making plants with modified plant phenotypes as described in USSN 12/139,269
  misc_feature (1)..(136): Ceres CLONE ID no. 1091493
  misc_feature (1)..(136): Utility: Useful for delaying flowering time
MASPDVEYRCFVGGLAWATDDRALETAFSQFGDVLDSKIINDRETGRSRGFGFVTFKDEKSMKDAIEGMNGQDLDGRSITVNEAQSRGSGGGGGGRGGGGGGYRSGGGGGYGGGGGGYGGGGGRREGGYSGGGGGG

SEQ ID NO: 5949 - protein, 151 aa, Brassica napus
  misc_feature (1)..(151): useful for making plants with modified plant phenotypes as described in USSN 12/139,269
  misc_feature (1)..(151): Ceres CLONE ID no. 945779
  misc_feature (1)..(151): Utility: Useful for delaying flowering time
MAAPDVEYRCFVGGLAWATDERSLETAFSKFGELVDSKIINDRETGRSRGFGFVTFKDEQSMKDAIEGMNGQDLDGRSITVNEAQSRGSGGGGRGGGGGYRGGGGGGYGGGGGGYGGGRREGGYSGGGGGYSSRGGGGGGYGGGGRREGGG

SEQ ID NO: 5950 - protein, 153 aa, Brassica napus
  misc_feature (1)..(153): useful for making plants with modified plant phenotypes as described in USSN 12/139,269
  misc_feature (1)..(153): Ceres CLONE ID no. 1092319
  misc_feature (1)..(153): Utility: Useful for delaying flowering time
MAAPDVEYRCFVGGLAWATDERSLETAFSKFGELVDSKIINDRETGRSRGFGFVTFKDEQSMKDAIEGMNGQDLDGRSITVNEAQSRGSGGGGGGRGGGGGYRGGGGGGGYGGGGGGYGGGRREGGYSGGGGGYSSRGGGGGGYGGGGRREGG

SEQ ID NO: 5951 - protein, 146 aa, Brassica napus
  misc_feature (1)..(146): useful for making plants with modified plant phenotypes as described in USSN 12/139,269
  misc_feature (1)..(146): Ceres CLONE ID no. 965777
  misc_feature (1)..(146): Utility: Useful for delaying flowering time
MASPDVEYRCFVGGLAWATDERSLETAFSKFGELVDSKIINDRETGRSRGFGFVTFKDEQSMKDAIEGMNGQDLDGRSITVNEAQSRGSGGGGGGRGGGGGYRGGGGGYGGGGGYGGGRREGGYSGGGGGGYSSRGGGGGGYGGGG

SEQ ID NO: 5952 - protein, 133 aa, Brassica napus
  misc_feature (1)..(133): useful for making plants with modified plant phenotypes as described in USSN 12/139,269
  misc_feature (1)..(133): Ceres CLONE ID no. 963616
  misc_feature (1)..(133): Utility: Useful for delaying flowering time
  misc_feature (13)..(13): Xaa is any aa, unknown or other
MSEVEYRCFVGGXAWATGDAELERTFSQFGEVIDSKIINDRETGRSRGFGFVTFKDEKSMKDAIDEMNGKELDGRTITVNEAQSRGGGGGGGRGGGGYGDRRGGGGYGSGGGGYGGGGGRRDGGGYGGGDGSY

SEQ ID NO: 5953 - protein, 123 aa, Brassica napus
  misc_feature (1)..(123): useful for making plants with modified plant phenotypes as described in USSN 12/139,269
  misc_feature (1)..(123): Ceres CLONE ID no. 972545
  misc_feature (1)..(123): Utility: Useful for delaying flowering time
  misc_feature (11)..(11): Xaa is any aa, unknown or other
  misc_feature (27)..(27): Xaa is any aa, unknown or other
  misc_feature (78)..(78): Xaa is any aa, unknown or other
  misc_feature (80)..(80): Xaa is any aa, unknown or other
  misc_feature (108)..(108): Xaa is any aa, unknown or other
  misc_feature (120)..(120): Xaa is any aa, unknown or other
MSEVEYRCFVXGLAWATGDAELERTFXQFGEVIDSKIINDRETGRSRGFGFVTFKDEKSMKDAIDEMNGKELDGRTIXVXEAQSRGGGGGGGRGGGGYGDRRGGGGYXSGGGGRGGGGYXSGG

SEQ ID NO: 5954 - DNA, 765 bp, Arabidopsis thaliana
  misc_feature (1)..(765): useful for making plants with modified plant phenotypes as described in USSN 12/139,269
  misc_feature (1)..(765): Ceres CLONE ID no. 99657
  misc_feature (1)..(765): Also known as  Ceres CDNA ID no. 23371734
gacaaaaaaagaaacagtgaagaagaaaaaaaaaaaaggtcattttcattttctccatttgatttttgccgaccggagaaaatatcttcttgccgtcttcttcttcatttcaccaggaacttttatttgaaatcggtttgatttagccatggcaaacgcggcatcgggaatggctgtgcatgatgattgcaagctgaaatttatggaactgaaggcgaaaagaacattccgtaccatagtctacaagattgaggataagcaagtgattgtagagaaactcggtgaacctgaacaatcatatgatgactttgcagctagtcttccagctgatgattgccgatattgcatttacgatttcgactttgtcactgcggagaactgccagaagagcaagatcttcttgcatggtctccggacactgccaaagtgagagacaagatgatttacgcgagctctaaagataggttcaagagagaactagatggaattcaagtggaacttcaagctactgatccaacagaaatgggtcttgatgttttcaaaagccgcaccaactaagtaaaacaaaaccctgtaagggcatttgaataagtttggtttctggagtgaatatgtttcctctgactgttatgaaaactttttaacaccttcaacttcattctacttggtattattgtatgtctttgatgtgttatgtgtgccttgtgatggttttcaattagttttacatgtacaatacttgaaatcagattgttgctaagcttc

SEQ ID NO: 5955 - protein, 93 aa, Arabidopsis thaliana
  misc_feature (1)..(93): useful for making plants with modified plant phenotypes as described in USSN 12/139,269
  misc_feature (12)..(85): Pfam Name: Cofilin_ADF; Pfam Description: Cofilin/tropomyosin-type actin-binding protein
  misc_feature (1)..(93): Utility: Useful for delaying flowering time
  misc_feature (1)..(93): Utility: Useful for delaying senescence
  misc_feature (1)..(93): Utility: Useful for making taller plants and plants with longer inflorescences
MANAASGMAVHDDCKLKFMELKAKRTFRTIVYKIEDKQVIVEKLGEPEQSYDDFAASLPADDCRYCIYDFDFVTAENCQKSKIFLHGLRTLPK

SEQ ID NO: 5956 - protein, 112 aa, Brassica napus
  misc_feature (1)..(112): useful for making plants with modified plant phenotypes as described in USSN 12/139,269
  misc_feature (1)..(112): Ceres CLONE ID no. 976676
  misc_feature (1)..(112): Utility: Useful for delaying flowering time
  misc_feature (1)..(112): Utility: Useful for delaying senescence
  misc_feature (1)..(112): Utility: Useful for making taller plants and plants with longer inflorescences
MAVHDDCKLKFLELKAKRTFRTIVYKIEDKQVIVEKLGEPEQSYDDFAASLPDNECRYAIYDFDFVTEENCQKSKIFFIAWSPDTAKVRDKMIYASSKDRFKRELDGIQVEL

SEQ ID NO: 5957 - protein, 96 aa, Brassica napus
  misc_feature (1)..(96): useful for making plants with modified plant phenotypes as described in USSN 12/139,269
  misc_feature (1)..(96): Ceres CLONE ID no. 962705
  misc_feature (1)..(96): Utility: Useful for delaying flowering time
  misc_feature (1)..(96): Utility: Useful for delaying senescence
  misc_feature (1)..(96): Utility: Useful for making taller plants and plants with longer inflorescences
MAVHDDCKLKFLELKAKRTYRFIVYKIEEQQKQVVVEKLGEPGQSHDDFAASLPADECRYAIFDFDFVTAENCQKSKIFFVAWSPDTARVRSKMIY

SEQ ID NO: 5958 - protein, 96 aa, Brassica napus
  misc_feature (1)..(96): useful for making plants with modified plant phenotypes as described in USSN 12/139,269
  misc_feature (1)..(96): Ceres CLONE ID no. 1081690
  misc_feature (1)..(96): Utility: Useful for delaying flowering time
  misc_feature (1)..(96): Utility: Useful for delaying senescence
  misc_feature (1)..(96): Utility: Useful for making taller plants and plants with longer inflorescences
MAVHDDCKLKFLELKAKRTYRFIVYKIEEQQKQVVVEKLGEPGQSHDDFAASLPADECRYAIFDFDFVTAENCQKSKIFFIAWSPDTARVRSKMIY

SEQ ID NO: 5959 - protein, 119 aa, Glycine max
  misc_feature (1)..(119): useful for making plants with modified plant phenotypes as described in USSN 12/139,269
  misc_feature (1)..(119): Ceres CLONE ID no. 1076675
  misc_feature (1)..(119): Utility: Useful for delaying flowering time
  misc_feature (1)..(119): Utility: Useful for delaying senescence
  misc_feature (1)..(119): Utility: Useful for making taller plants and plants with longer inflorescences
MAVHDDCKLKFLELKAKRTYRFIVYKIEEQQKQVVVEKLGEPGQSHDDFAASLPADECRYAIFDFDFVTAENCQKSKIFFIAWSPDTARVRSKMIYASSKDRFKRELDGIQVELQATDP

SEQ ID NO: 5960 - protein, 97 aa, Brassica napus
  misc_feature (1)..(97): useful for making plants with modified plant phenotypes as described in USSN 12/139,269
  misc_feature (1)..(97): Ceres CLONE ID no. 1082802
  misc_feature (1)..(97): Utility: Useful for delaying flowering time
  misc_feature (1)..(97): Utility: Useful for delaying senescence
  misc_feature (1)..(97): Utility: Useful for making taller plants and plants with longer inflorescences
MAVHDDCKLKFLELKAKRTYRFIVYKIEEQQKQVVVEKLGEPGQSHDDFAASLPADECRYAIFDFDFVTAENCQKSKIFFIAWSPDTARVRSKMIYA

SEQ ID NO: 5961 - protein, 84 aa, Brassica napus
  misc_feature (1)..(84): useful for making plants with modified plant phenotypes as described in USSN 12/139,269
  misc_feature (1)..(84): Ceres CLONE ID no. 1102921
  misc_feature (1)..(84): Utility: Useful for delaying flowering time
  misc_feature (1)..(84): Utility: Useful for delaying senescence
  misc_feature (1)..(84): Utility: Useful for making taller plants and plants with longer inflorescences
  misc_feature (82)..(82): Xaa is any aa, unknown or other
MAVHDDCKLKFLELKAKRTYRFIVYKIEEQQKQVVVEKLGEPGQSHDDFAASLPADECRYAIFDFDFVTAENCQKSKIFFVXWS

SEQ ID NO: 5962 - protein, 132 aa, Zea mays
  misc_feature (1)..(132): useful for making plants with modified plant phenotypes as described in USSN 12/139,269
  misc_feature (1)..(132): Ceres CLONE ID no. 1061399
  misc_feature (1)..(132): Utility: Useful for delaying flowering time
  misc_feature (1)..(132): Utility: Useful for delaying senescence
  misc_feature (1)..(132): Utility: Useful for making taller plants and plants with longer inflorescences
MAVHDDCKLKFLELKAKRTYRFIVYKIEEQQKQVVVEKLGEPGQSHDDFAASLPADECRYAIFDFDFVTAENCQKSKIFFVAWSPDTARVRSKMIYASSKDRFKRELDGIQVELQATDPTEMDLDVFKSRAN

SEQ ID NO: 5963 - protein, 90 aa, Brassica napus
  misc_feature (1)..(90): useful for making plants with modified plant phenotypes as described in USSN 12/139,269
  misc_feature (1)..(90): Ceres CLONE ID no. 1040255
  misc_feature (1)..(90): Utility: Useful for delaying flowering time
  misc_feature (1)..(90): Utility: Useful for delaying senescence
  misc_feature (1)..(90): Utility: Useful for making taller plants and plants with longer inflorescences
MAVHDDCKLKFLELKAKRTFRFIVYKIEEQQKQVVVEKLGEPGQSHDDFAASLPADECRYAVFDFDFVTAESCQKSKIFFVAWSPDTARV

SEQ ID NO: 5964 - protein, 106 aa, Brassica napus
  misc_feature (1)..(106): useful for making plants with modified plant phenotypes as described in USSN 12/139,269
  misc_feature (1)..(106): Ceres CLONE ID no. 1040515
  misc_feature (1)..(106): Utility: Useful for delaying flowering time
  misc_feature (1)..(106): Utility: Useful for delaying senescence
  misc_feature (1)..(106): Utility: Useful for making taller plants and plants with longer inflorescences
  misc_feature (104)..(104): Xaa is any aa, unknown or other
MAVHDDCKLKFLELKAKRTFRFIVYKIEEQQKQVVVEKLGEPGQSHDDFAASLPADECRYAVFDFDFVTAESCQKSKIFFVAWSPDTARVRSKMIYASSKDRFXRE

SEQ ID NO: 5965 - protein, 132 aa, Zea mays
  misc_feature (1)..(132): useful for making plants with modified plant phenotypes as described in USSN 12/139,269
  misc_feature (1)..(132): Ceres CLONE ID no. 1389554
  misc_feature (1)..(132): Utility: Useful for delaying flowering time
  misc_feature (1)..(132): Utility: Useful for delaying senescence
  misc_feature (1)..(132): Utility: Useful for making taller plants and plants with longer inflorescences
MAVHDDCKLKFLELKAKRTFRFIVYKIEEQQKQVVVEKLGEPGQSHDDFAASLPADECRYAVFDFDFVTAESCQKSKIFFVAWSPDTARVRSKMIYASSKDRFKRELDGIQVELQATDPTEMDLDVFKSRAN

SEQ ID NO: 5966 - protein, 105 aa, Glycine max
  misc_feature (1)..(105): useful for making plants with modified plant phenotypes as described in USSN 12/139,269
  misc_feature (1)..(105): Ceres CLONE ID no. 615044
  misc_feature (1)..(105): Utility: Useful for delaying flowering time
  misc_feature (1)..(105): Utility: Useful for delaying senescence
  misc_feature (1)..(105): Utility: Useful for making taller plants and plants with longer inflorescences
MANAASGMAVHDDCKLKFLELKAKRTYRFIVFKIEEKQKQVIVEKLGEPANGYDDFAASLPADECRYAVYDFDFVTEENCQKSRIFFIAWSPDTSRVRSKMIYAS

SEQ ID NO: 5967 - protein, 132 aa, Triticum aestivum
  misc_feature (1)..(132): useful for making plants with modified plant phenotypes as described in USSN 12/139,269
  misc_feature (1)..(132): Ceres CLONE ID no. 1053159
  misc_feature (1)..(132): Utility: Useful for delaying flowering time
  misc_feature (1)..(132): Utility: Useful for delaying senescence
  misc_feature (1)..(132): Utility: Useful for making taller plants and plants with longer inflorescences
MAVHDDCKLRFLELKAKRTHRFIVYKIEEKQKQVIVEKVGEPIQTYEDFAASLPAEECRYAIYDFDFVTAENCQKSKIFFIAWCPDVAKVRSKMIYASSKDRFKRELDGIQVELQATDPTEMDLDVFKSRVN

SEQ ID NO: 5968 - protein, 120 aa, Brassica napus
  misc_feature (1)..(120): useful for making plants with modified plant phenotypes as described in USSN 12/139,269
  misc_feature (1)..(120): Ceres CLONE ID no. 1266787
  misc_feature (1)..(120): Utility: Useful for delaying flowering time
  misc_feature (1)..(120): Utility: Useful for delaying senescence
  misc_feature (1)..(120): Utility: Useful for making taller plants and plants with longer inflorescences
MAVHDDCKLRFLELKAKRTHRFIVYKIEEKQKQVIVEKVGEPIQTYEDFAASLPAEECRYAIYDFDFVTAENCQKSKIFFIAWCPDVAKVRSKMIYASSKDRFKRELDGIQVELQATDPT

SEQ ID NO: 5969 - protein, 113 aa, Brassica napus
  misc_feature (1)..(113): useful for making plants with modified plant phenotypes as described in USSN 12/139,269
  misc_feature (1)..(113): Ceres CLONE ID no. 1309442
  misc_feature (1)..(113): Utility: Useful for delaying flowering time
  misc_feature (1)..(113): Utility: Useful for delaying senescence
  misc_feature (1)..(113): Utility: Useful for making taller plants and plants with longer inflorescences
  misc_feature (84)..(84): Xaa is any aa, unknown or other
  misc_feature (110)..(110): Xaa is any aa, unknown or other
MAVHDDCKLRFLELKAKRTHRFIVYKIEEKQKQVIVEKVGEPIQTYEDFAASLPAEECRYAIYDFDFVTAENCQKSKIFFIAWXPDVAKVRSKMIYASSKEASKDEPEEXKQA

SEQ ID NO: 5970 - protein, 125 aa, Zea mays
  misc_feature (1)..(125): useful for making plants with modified plant phenotypes as described in USSN 12/139,269
  misc_feature (1)..(125): Ceres CLONE ID no. 1425999
  misc_feature (1)..(125): Utility: Useful for delaying flowering time
  misc_feature (1)..(125): Utility: Useful for delaying senescence
  misc_feature (1)..(125): Utility: Useful for making taller plants and plants with longer inflorescences
  misc_feature (100)..(100): Xaa is any aa, unknown or other
  misc_feature (119)..(119): Xaa is any aa, unknown or other
MAVHDDCKLRFLELKAKRTHRFIVYKIEEKQKQVIVEKVGEPIQTYEDFAASLPAEECRYAIYDFDFVTAENCQKSKIFFIAWCPDVAKVRSKMIYASSXDRFKRELDGIQVELQATDXTGDGSW

SEQ ID NO: 5971 - protein, 183 aa, Glycine max
  misc_feature (1)..(183): useful for making plants with modified plant phenotypes as described in USSN 12/139,269
  misc_feature (1)..(183): Ceres CLONE ID no. 473223
  misc_feature (1)..(183): Utility: Useful for delaying flowering time
  misc_feature (1)..(183): Utility: Useful for delaying senescence
  misc_feature (1)..(183): Utility: Useful for making taller plants and plants with longer inflorescences
LHFLLPFLSSFLPQPNLRLRPQQLLLQDRCQRYFPFLPFILEKKMANAASGMAVHDECKLKFLELKAKRTYRYIVFKIEEKSKQVIVEKLGDPANGYDEFAASLPADECRYAVYDFDFVTEENCQKSRIFFIAWSPDTSRVRSKMIYASSKDRFKRELDGIQIELQATDPTEMGLDVFKSRAN

SEQ ID NO: 5972 - DNA, 1093 bp, Arabidopsis thaliana
  misc_feature (1)..(1093): useful for making plants with modified plant phenotypes as described in USSN 12/139,269
  misc_feature (1)..(1093): Ceres CLONE ID no. 100465
  misc_feature (1)..(1093): Also known as  Ceres CDNA ID no. 23362514
aatacctttgatatttgcctgcacgtccccaaacaagtagagaataataatcacatcaagattgattaaaaccctctcactaatcaccttcttaatcaccaccctctccggctctcaacagaacaacaacaaaaaaacagcttccgttgtcctgttccggcgaaatcggacggtcgagatcaatcatgcatcgtagagcagcaattcaagaatcggatgacgaagaagatgagacttacaacgacgtcgttcctgaatctccttcttcttgtgaagactcaaagatctcaaaaccaactccaaagaaaagtaggaggaacgtagagaagagagttgtctcagttccgatagctgacgtggaaggatctaagagcagaggcgaagtatatccaccgtccgattcatgggcctggagaaagtacggacaaaaaccgatcaaaggctcgccttatcccaggggatattacagatgtagtagctcaaaaggatgtccggcgaggaagcaggtggagagaagccgtgtggacccttctaagcttatgattacttacgcctgcgaccacaatcaccctttcccttcctcctccgctaacaccaaatcccaccaccgctcctccgtcgtcctcaaaaccgcaaagaaagaggaagaatacgaagaggaggaagaagaactaaccgtcaccgccgcagaggaaccaccggcgggacttgatctaagccacgtagactcaccgttgctattaggcggctgctacagcgaaatcggagagttcgggtggttctacgacgcgtcgatctcatcatcatctggttcttcgaatttcctcgacgtaactctagagagaggtttttcagtaggccaagaggaagatgagtctttgttcggtgatctcggtgatttacctgattgcgcctccgtgttccgccgtgggactgttgcgacggaggagcaacatcgaagatgtgattttggcgccattcctttctgtgatagttctagatgagtttgtgtgtgtagccaaaaccaaaagaaaaaaacacaatttttttattttccactgtaaaggtgtatcaatggtggattcattttttt

SEQ ID NO: 5973 - protein, 272 aa, Arabidopsis thaliana
  misc_feature (1)..(272): useful for making plants with modified plant phenotypes as described in USSN 12/139,269
  misc_feature (70)..(130): Pfam Name: WRKY; Pfam Description: WRKY DNA -binding domain
  misc_feature (1)..(272): Utility: Useful for delaying flowering time
  misc_feature (1)..(272): Utility: Useful for increasing chlorophyll and photosynthetic capacity
  misc_feature (1)..(272): Utility: Useful for making smaller plants
  misc_feature (1)..(272): Utility: Useful for making stronger plants
MHRRAAIQESDDEEDETYNDVVPESPSSCEDSKISKPTPKKSRRNVEKRVVSVPIADVEGSKSRGEVYPPSDSWAWRKYGQKPIKGSPYPRGYYRCSSSKGCPARKQVERSRVDPSKLMITYACDHNHPFPSSSANTKSHHRSSVVLKTAKKEEEYEEEEEELTVTAAEEPPAGLDLSHVDSPLLLGGCYSEIGEFGWFYDASISSSSGSSNFLDVTLERGFSVGQEEDESLFGDLGDLPDCASVFRRGTVATEEQHRRCDFGAIPFCDSSR

SEQ ID NO: 5974 - protein, 272 aa, Arabidopsis thaliana
  misc_feature (1)..(272): useful for making plants with modified plant phenotypes as described in USSN 12/139,269
  misc_feature (1)..(272): Public GI no. 49333371
  misc_feature (1)..(272): Utility: Useful for delaying flowering time
  misc_feature (1)..(272): Utility: Useful for increasing chlorophyll and photosynthetic capacity
  misc_feature (1)..(272): Utility: Useful for making smaller plants
  misc_feature (1)..(272): Utility: Useful for making stronger plants
MDGGGSSSNSFRKVRNPFVTDQELEESDNVSSVTGAESPPPSTTKKGKRSMQKRVVSVPIKDVEGSRLKGEGAPPSDSWAWRKYGQKPIKGSPYPRGYYRCSSSKGCPARKQVERSRVNPTMLVITYSCEHNHAWPASRHNNTSAKQAAAAAGEASESPTKSTTAVKHDPSTSQPDTEPDSGMEDGFACLTEDSILTTGDEFAWFGEMETTSSTVLESSLFSERDNSEADDTAVISPMREEDESLFADLGELPECSFVFRHQRNVGPQVGIC

SEQ ID NO: 5975 - protein, 273 aa, Arabidopsis thaliana
  misc_feature (1)..(273): useful for making plants with modified plant phenotypes as described in USSN 12/139,269
  misc_feature (1)..(273): Public GI no. 49333385
  misc_feature (1)..(273): Utility: Useful for delaying flowering time
  misc_feature (1)..(273): Utility: Useful for increasing chlorophyll and photosynthetic capacity
  misc_feature (1)..(273): Utility: Useful for making smaller plants
  misc_feature (1)..(273): Utility: Useful for making stronger plants
MDSGGSSSSSFRKVRNPFVTDQELEESDNVSSVTGAESPPPSTTKKGKRSMQKRVVSVPIKDVEGSRLKGEGAPPSDSWAWRKYGQKPIKGSPYPRGYYRCSSSKGCPARKQVERSRVNPTMLVITYSCEHNHAWPASRHNNTSAKQAAAAAAGEASESPTKSSTAVKHEPSTSQPDTEPDSGMEDGFACLTEDSILTTGDEFAWFGEMETTSSTVLESPLFSERDNSEADDTAMIFPMREEDESLFADLEELPECSFVFRHQRNVGPQVGIC

SEQ ID NO: 5976 - DNA, 1604 bp, Arabidopsis thaliana
  misc_feature (1)..(1604): useful for making plants with modified plant phenotypes as described in USSN 12/139,269
  misc_feature (1)..(1604): Ceres CLONE ID no. 107731
  misc_feature (1)..(1604): Also known as  Ceres CDNA ID no. 23388514
  misc_feature (395)..(395): n is a, c, t, g, unknown, or other
  misc_feature (397)..(397): n is a, c, t, g, unknown, or other
aaaaaagagtcgcccattttcttctcatttttttttgctcttgacgaagaaaccaaaaaaaaaaaaaatgagagagatccttcatatccaaggcggtcaatgtggaaaccagatcggagcaaagttctgggaagtgatctgcgacgaacacggcattgatcacaccggtcaatacgtcggcgattctccgttacagcttgaacgtatcgatgtctatttcaacgaagctagcggtggaaagtacgttcctcgcgctgttcttatggatctggagcctggtaccatggattctctcagatctggtccgttcggtcagattttccgtcctgataacttcgtctttggtcaatctggtgccggaaataactgggcgaaaggtcattacaccgaagtcntngagttgattgattctgttctcgatgttgtgaggaaggaagctgagaacagcgattgtcttcaaggtttccaagtgtgtcattcattgggaggaggaactggatctggaatgggaactctattgatttctaagataagagaagagtatccagatcgtatgatgatgactttctcagtgtttccttctcctaaggtctctgacactgttgttgagccatacaatgcaactctctctgtgcatcagcttgtcgaaaacgctgacgagtgtatggttttggacaatgaggctctctacgatatctgtttccgtaccctcaagctcgctaatcctacctttggtgatcttaaccatctcatctctgctacaatgagtggtgttacttgctgtcttcgtttccctggtcagcttaactctgaccttaggaaactcgctgtgaaccttatcccattcccaaggcttcacttcttcatggttggtttcgcaccattgacatcgagaggatcacagcaatacagtgccttgagtgttcctgaactgacccagcagatgtgggatgcaaagaacatgatgtgtgctgctgaccctcgtcatggacgttacttgactgcatccgctgtgttccgtggaaagctgagcaccaaagaggttgacgagcagatgatgaacattcagaacaagaactcatcctactttgtggaatggatcccaaacaacgtcaagtccagtgtctgtgatattgcaccaaagggtttgaaaatggcgtctactttcattggtaactcaacctcaatccaggagatgttttaggcgtgtgagcgaacagttcacagctatgttcaggagaaaggctttccttcattggtacacaggagaaggcatggacgagatggagttcactgaagcagagagtaacatgaatgatcttgtcgcagagtaccagcagtaccaagatgctacagccggagaggaggagtacgaggaggaagaagaggagtacgagacttaagatgttgtcaatggctccctcggattcgtaagctgtgtaagcaagcagctttcactttcttctttccccttatcctgaatttttttcttcgtaatatctcttttattgtttcgttcatgtgtgttcgttttgttattgaaaccctatatcggttctggatttgttaaacttttgcgtgtattgcttattgtttttgtcggc

SEQ ID NO: 5977 - protein, 331 aa, Arabidopsis thaliana
  misc_feature (1)..(331): useful for making plants with modified plant phenotypes as described in USSN 12/139,269
  misc_feature (64)..(197): Pfam Name: Tubulin; Pfam Description: Tubulin/FtsZ family, GTPase domain
  misc_feature (199)..(331): Pfam Name: Tubulin_C; Pfam Description: Tubulin/FtsZ family, C-terminal domain
  misc_feature (1)..(331): Utility: Useful for delaying flowering time
  misc_feature (1)..(331): Utility: Useful for increasing chlorophyll and photosynthetic capacity
  misc_feature (1)..(331): Utility: Useful for increasing increasing anthocyanin content
  misc_feature (1)..(331): Utility: Useful for making plants with altered leaf shape eg curled leaves
  misc_feature (1)..(331): Utility: Useful for making plants with modified flowers
  misc_feature (62)..(62): Xaa is any aa, unknown or other
  misc_feature (63)..(63): Xaa is any aa, unknown or other
MSISTKLAVESTFLALFLWIWSLVPWILSDLVRSVRFSVLITSSLVNLVPEITGRKVITPKXXELIDSVLDVVRKEAENSDCLQGFQVCHSLGGGTGSGMGTLLISKIREEYPDRMMMTFSVFPSPKVSDTVVEPYNATLSVHQLVENADECMVLDNEALYDICFRTLKLANPTFGDLNHLISATMSGVTCCLRFPGQLNSDLRKLAVNLIPFPRLHFFMVGFAPLTSRGSQQYSALSVPELTQQMWDAKNMMCAADPRHGRYLTASAVFRGKLSTKEVDEQMMNIQNKNSSYFVEWIPNNVKSSVCDIAPKGLKMASTFIGNSTSIQEMF

SEQ ID NO: 5978 - protein, 381 aa, Glycine max
  misc_feature (1)..(381): useful for making plants with modified plant phenotypes as described in USSN 12/139,269
  misc_feature (1)..(381): Ceres CLONE ID no. 661643
  misc_feature (1)..(381): Utility: Useful for delaying flowering time
  misc_feature (1)..(381): Utility: Useful for increasing chlorophyll and photosynthetic capacity
  misc_feature (1)..(381): Utility: Useful for increasing increasing anthocyanin content
  misc_feature (1)..(381): Utility: Useful for making plants with altered leaf shape eg curled leaves
  misc_feature (1)..(381): Utility: Useful for making plants with modified flowers
MDLEPGTMDSVRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPKGLKMASTFIGNSTSIQEMFRRVSEQFTAMFRRKAFLHWYTGEGMDEMEFTEAESNMNDLVAEYQQYQDATADEEEYEEEEEEEEIGA

SEQ ID NO: 5979 - protein, 442 aa, Glycine max; identical to SEQ ID NO: 5732
  misc_feature (1)..(442): useful for making plants with modified plant phenotypes as described in USSN 12/139,269
  misc_feature (1)..(442): Ceres CLONE ID no. 471579
  misc_feature (1)..(442): Utility: Useful for delaying flowering time
  misc_feature (1)..(442): Utility: Useful for increasing chlorophyll and photosynthetic capacity
  misc_feature (1)..(442): Utility: Useful for increasing increasing anthocyanin content
  misc_feature (1)..(442): Utility: Useful for making plants with altered leaf shape eg curled leaves
  misc_feature (1)..(442): Utility: Useful for making plants with modified flowers

SEQ ID NO: 5980 - protein, 379 aa, Zea mays
  misc_feature (1)..(379): useful for making plants with modified plant phenotypes as described in USSN 12/139,269
  misc_feature (1)..(379): Ceres CLONE ID no. 364892
  misc_feature (1)..(379): Utility: Useful for delaying flowering time
  misc_feature (1)..(379): Utility: Useful for increasing chlorophyll and photosynthetic capacity
  misc_feature (1)..(379): Utility: Useful for increasing increasing anthocyanin content
  misc_feature (1)..(379): Utility: Useful for making plants with altered leaf shape eg curled leaves
  misc_feature (1)..(379): Utility: Useful for making plants with modified flowers
MDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPRGLSMASTFIGNSTSIQEMFRRVSEQFTAMFRRKAFLHWYTGEGMDEMEFTEAESNMNDLVSEYQQYQDATADEEEYEDEEEVHDE

SEQ ID NO: 5981 - protein, 445 aa, Triticum aestivum; identical to SEQ ID NO: 5738
  misc_feature (1)..(445): useful for making plants with modified plant phenotypes as described in USSN 12/139,269
  misc_feature (1)..(445): Ceres CLONE ID no. 726433
  misc_feature (1)..(445): Utility: Useful for delaying flowering time
  misc_feature (1)..(445): Utility: Useful for increasing chlorophyll and photosynthetic capacity
  misc_feature (1)..(445): Utility: Useful for increasing increasing anthocyanin content
  misc_feature (1)..(445): Utility: Useful for making plants with altered leaf shape eg curled leaves
  misc_feature (1)..(445): Utility: Useful for making plants with modified flowers

SEQ ID NO: 5982 - protein, 445 aa, Zea mays; identical to SEQ ID NO: 5737
  misc_feature (1)..(445): useful for making plants with modified plant phenotypes as described in USSN 12/139,269
  misc_feature (1)..(445): Ceres CLONE ID no. 705622
  misc_feature (1)..(445): Utility: Useful for delaying flowering time
  misc_feature (1)..(445): Utility: Useful for increasing chlorophyll and photosynthetic capacity
  misc_feature (1)..(445): Utility: Useful for increasing increasing anthocyanin content
  misc_feature (1)..(445): Utility: Useful for making plants with altered leaf shape eg curled leaves
  misc_feature (1)..(445): Utility: Useful for making plants with modified flowers

SEQ ID NO: 5983 - protein, 373 aa, Zea mays
  misc_feature (1)..(373): useful for making plants with modified plant phenotypes as described in USSN 12/139,269
  misc_feature (1)..(373): Ceres CLONE ID no. 306678
  misc_feature (1)..(373): Utility: Useful for delaying flowering time
  misc_feature (1)..(373): Utility: Useful for increasing chlorophyll and photosynthetic capacity
  misc_feature (1)..(373): Utility: Useful for increasing increasing anthocyanin content
  misc_feature (1)..(373): Utility: Useful for making plants with altered leaf shape eg curled leaves
  misc_feature (1)..(373): Utility: Useful for making plants with modified flowers
MDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLSTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMLNVQNKNSSYFVEWIPNNVKSSVCDIPPRGLKMAGTFVGNSTSIQEMFRRVSEQFTAMFRRKAFLHWYTGEGMDEMEFTEAESNMNDLVAEYQQYQDATADEEYEDEEEEENVAE

SEQ ID NO: 5984 - protein, 445 aa, Triticum aestivum; identical to SEQ ID NO: 5731
  misc_feature (1)..(445): useful for making plants with modified plant phenotypes as described in USSN 12/139,269
  misc_feature (1)..(445): Ceres CLONE ID no. 861902
  misc_feature (1)..(445): Utility: Useful for delaying flowering time
  misc_feature (1)..(445): Utility: Useful for increasing chlorophyll and photosynthetic capacity
  misc_feature (1)..(445): Utility: Useful for increasing increasing anthocyanin content
  misc_feature (1)..(445): Utility: Useful for making plants with altered leaf shape eg curled leaves
  misc_feature (1)..(445): Utility: Useful for making plants with modified flowers

SEQ ID NO: 5985 - protein, 447 aa, Triticum aestivum; identical to SEQ ID NO: 5736
  misc_feature (1)..(447): useful for making plants with modified plant phenotypes as described in USSN 12/139,269
  misc_feature (1)..(447): Ceres CLONE ID no. 725504
  misc_feature (1)..(447): Utility: Useful for delaying flowering time
  misc_feature (1)..(447): Utility: Useful for increasing chlorophyll and photosynthetic capacity
  misc_feature (1)..(447): Utility: Useful for increasing increasing anthocyanin content
  misc_feature (1)..(447): Utility: Useful for making plants with altered leaf shape eg curled leaves
  misc_feature (1)..(447): Utility: Useful for making plants with modified flowers

SEQ ID NO: 5986 - protein, 447 aa, Zea mays; identical to SEQ ID NO: 5741
  misc_feature (1)..(447): useful for making plants with modified plant phenotypes as described in USSN 12/139,269
  misc_feature (1)..(447): Ceres CLONE ID no. 1412402
  misc_feature (1)..(447): Utility: Useful for delaying flowering time
  misc_feature (1)..(447): Utility: Useful for increasing chlorophyll and photosynthetic capacity
  misc_feature (1)..(447): Utility: Useful for increasing increasing anthocyanin content
  misc_feature (1)..(447): Utility: Useful for making plants with altered leaf shape eg curled leaves
  misc_feature (1)..(447): Utility: Useful for making plants with modified flowers

SEQ ID NO: 5987 - protein, 445 aa, Zea mays; identical to SEQ ID NO: 5733
  misc_feature (1)..(445): useful for making plants with modified plant phenotypes as described in USSN 12/139,269
  misc_feature (1)..(445): Ceres CLONE ID no. 422618
  misc_feature (1)..(445): Utility: Useful for delaying flowering time
  misc_feature (1)..(445): Utility: Useful for increasing chlorophyll and photosynthetic capacity
  misc_feature (1)..(445): Utility: Useful for increasing increasing anthocyanin content
  misc_feature (1)..(445): Utility: Useful for making plants with altered leaf shape eg curled leaves
  misc_feature (1)..(445): Utility: Useful for making plants with modified flowers

SEQ ID NO: 5988 - protein, 445 aa, Zea mays; identical to SEQ ID NO: 5740
  misc_feature (1)..(445): useful for making plants with modified plant phenotypes as described in USSN 12/139,269
  misc_feature (1)..(445): Ceres CLONE ID no. 264576
  misc_feature (1)..(445): Utility: Useful for delaying flowering time
  misc_feature (1)..(445): Utility: Useful for increasing chlorophyll and photosynthetic capacity
  misc_feature (1)..(445): Utility: Useful for increasing increasing anthocyanin content
  misc_feature (1)..(445): Utility: Useful for making plants with altered leaf shape eg curled leaves
  misc_feature (1)..(445): Utility: Useful for making plants with modified flowers

SEQ ID NO: 5989 - protein, 444 aa, Triticum aestivum; identical to SEQ ID NO: 5734
  misc_feature (1)..(444): useful for making plants with modified plant phenotypes as described in USSN 12/139,269
  misc_feature (1)..(444): Ceres CLONE ID no. 686137
  misc_feature (1)..(444): Utility: Useful for delaying flowering time
  misc_feature (1)..(444): Utility: Useful for increasing chlorophyll and photosynthetic capacity
  misc_feature (1)..(444): Utility: Useful for increasing increasing anthocyanin content
  misc_feature (1)..(444): Utility: Useful for making plants with altered leaf shape eg curled leaves
  misc_feature (1)..(444): Utility: Useful for making plants with modified flowers

SEQ ID NO: 5990 - DNA, 1670 bp, Arabidopsis thaliana
  misc_feature (1)..(1670): useful for making plants with modified plant phenotypes as described in USSN 12/139,269
  misc_feature (1)..(1670): Ceres CLONE ID no. 110454
  misc_feature (1)..(1670): Also known as  Ceres CDNA ID no. 23462475
aaaaaggatcaaacatagtatagcttggactctttttgccgtctatgatctctctcaatctctcatcttagctttctttctctctctctttgtgtcttcatttgtttatctcatcaatggattcaaattttcattactcgatagatcttaacgaagatcaaaaccatcacgaacaaccctttttctatcctcttggatcctcttcctcgcttcatcatcatcatcatcatcatcatcatcaagtcccttctaattcttcatcttcttcttcgtccatttcatcgctctcctcttacctccctttcttgatcaactctcaagaagatcaacatgttgcctacaacaacacttatcacgctgatcatctccatctttctcaacccctcaaggccaagatgtttgtggctaacggtggatcatcatcatgcgatcacatggtgccaaagaaggagacaagactgaaactaacgataaggaaaaaagatcacgaagaccaaccccatcctcttcatcaaaacccgacaaaacccgattcagactccgacaagtggttgatgtccccaaagatgcggttgatcaagaaaacaatcaccaacaataaacagctcactgatcagactaataataataatcataaagaaagtgatcactaccctttgaatcataagactaatttcgacgaggatcaccatgaagatcttaatttcaagaacgtcttgaccaggaagaccacggccgcgaccaccgagaatcgctacaatacaatcaacgagaacggttatagtaataacaatggcgtgattagggtttgttcggattgtaacaccaccaagactcctctttggcgaagtggacctcgaggtcccaagtctctttgtaacgcatgtggtatacggcaaagaaaggcaaggcgagccgctatggccgcggccgctgcagccggcgaccaagaggtggcggtagcgccccgagtgcaacaattaccgctgaaaaagaagttgcaaaataaaaaaaaagagatcaaacggaggggaaaaatacaatcactctcctccaatggtggccaaggccaaaaagtgcaagatcaaagaggaagaggagaaggaaatggaagcggaaacggttgccggagattcagagatcagcaaatctacaacttcttctaattcttcgatttcgtcaaacaaattttgcttcgatgatttgacaataatgttgagcaaaagctcagcttatcaacaagtgttcccacaagatgagaaggaggctgctgttttgctcatggctctgtcgtatggaatggttcacggttgatcagatcatcacaatatcctcattacaaaaaggtttattttaatagtaatatatagattatagtaatcataataatgattgattgttaaatcttggagtgattagtttagtttttgcagttggtctaatatcaggagtcaaaacattttataataagagtgtgtgagagtttaatatgataattaatagctctatatatgtttatggagattttggttttgagtttgttgtgtttttgttttccgatggaacgaacattagtcacccgataatgtgggtaattcttgttcatttacaagttttatagtactgtattgtgtaacgaggttggagaaataatataatcaattaagggt

SEQ ID NO: 5991 - protein, 349 aa, Arabidopsis thaliana
  misc_feature (1)..(349): useful for making plants with modified plant phenotypes as described in USSN 12/139,269
  misc_feature (232)..(267): Pfam Name: GATA; Pfam Description: GATA zinc finger
  misc_feature (1)..(349): Utility: Useful for delaying flowering time
  misc_feature (1)..(349): Utility: Useful for increasing chlorophyll and photosynthetic capacity
  misc_feature (1)..(349): Utility: Useful for increasing increasing anthocyanin content
  misc_feature (1)..(349): Utility: Useful for making plants with increased biomass and foliage
  misc_feature (1)..(349): Utility: Useful for making smaller plants
MDSNFHYSIDLNEDQNHHEQPFFYPLGSSSSLHHHHHHHHHQVPSNSSSSSSSISSLSSYLPFLINSQEDQHVAYNNTYHADHLHLSQPLKAKMFVANGGSSSCDHMVPKKETRLKLTIRKKDHEDQPHPLHQNPTKPDSDSDKWLMSPKMRLIKKTITNNKQLTDQTNNNNHKESDHYPLNHKTNFDEDHHEDLNFKNVLTRKTTAATTENRYNTINENGYSNNNGVIRVCSDCNTTKTPLWRSGPRGPKSLCNACGIRQRKARRAAMAAAAAAGDQEVAVAPRVQQLPLKKKLQNKKKEIKRRGKIQSLSSNGGQGQKVQDQRGRGEGNGSGNGCRRFRDQQIYNFF

SEQ ID NO: 5992 - protein, 353 aa, Arabidopsis thaliana
  misc_feature (1)..(353): useful for making plants with modified plant phenotypes as described in USSN 12/139,269
  misc_feature (1)..(353): Public GI no. 50906397
  misc_feature (1)..(353): Utility: Useful for delaying flowering time
  misc_feature (1)..(353): Utility: Useful for increasing chlorophyll and photosynthetic capacity
  misc_feature (1)..(353): Utility: Useful for increasing increasing anthocyanin content
  misc_feature (1)..(353): Utility: Useful for making plants with increased biomass and foliage
  misc_feature (1)..(353): Utility: Useful for making smaller plants
MSTIYMSQLPATLPLMEGDQDQGLYPAFHRAKDPPILFPFMIDSAVEHQGQIYGDQGLRRQQVLGESNQQFNDHMMMGGSDVFLTPSPFRPTIQSIGSDMIQRSSYDPYDIESNNKQHANGSTSKWMSTPPMKMRIIRKGAATDPEGGAVRKPRRRAQAHQDESQQQLQQALGVVRVCSDCNTTKTPLWRSGPCGPKSLCNACGIRQRKARRAMAAAANGGAAVAPAKSVAAAPVNNKPAAKKEKRAADVDRSLPFKKRCKMVDHVAAAVAATKPTAAGEVVAAAPKDQDHVIVVGGENAAATSMPAQNPISKAAATAAAAAASPAFFHGLPRDEITDAAMLLMTLSCGLVHS

SEQ ID NO: 5993 - protein, 356 aa, Triticum aestivum
  misc_feature (1)..(356): useful for making plants with modified plant phenotypes as described in USSN 12/139,269
  misc_feature (1)..(356): Ceres CLONE ID no. 788183
  misc_feature (1)..(356): Utility: Useful for delaying flowering time
  misc_feature (1)..(356): Utility: Useful for increasing chlorophyll and photosynthetic capacity
  misc_feature (1)..(356): Utility: Useful for increasing increasing anthocyanin content
  misc_feature (1)..(356): Utility: Useful for making plants with increased biomass and foliage
  misc_feature (1)..(356): Utility: Useful for making smaller plants
MSTIYMSQLSTSFPLMEEDHHQDHHQGHFQAFTLPKDPPILFPFVISNSSPSDNSSLGYGSDQHLMQHHAMLDQPQHMIGGSSSVFSTPFPTVESIRDDMIERSYSYDPYDMEKLQATSGGSLKIGKWAAPAPAAKMRITRKTSDPGVKKPRKRAQAYEDHGHMGGMNQALGVIRTCSDCNTTKTPLWRSGPCGPKSLCNACGIRQRKARRAMMATGAAPATDVGAKAAAPGDAAVTVRPPKVKKEKRAVDVDRSLPFKKRCKVVQDHTATHDAASTTVEAAAEPPVVVPTTAPAAAPGSDLVDTIGANWSKSPTAAPAACFRPSPAPFAVPVPVQDEITDAAMLLMTLSCELVRS

SEQ ID NO: 5994 - protein, 306 aa, Glycine max
  misc_feature (1)..(306): useful for making plants with modified plant phenotypes as described in USSN 12/139,269
  misc_feature (1)..(306): Ceres CLONE ID no. 544756
  misc_feature (1)..(306): Utility: Useful for delaying flowering time
  misc_feature (1)..(306): Utility: Useful for increasing chlorophyll and photosynthetic capacity
  misc_feature (1)..(306): Utility: Useful for increasing increasing anthocyanin content
  misc_feature (1)..(306): Utility: Useful for making plants with increased biomass and foliage
  misc_feature (1)..(306): Utility: Useful for making smaller plants
MTPYSLNPPGPSIQAGQTQLFNISPNNQDCRTIFNIFDPRKTRIEIGGLRDNYHQQDDKMMVLHDGSSSNSNKSSFNNNISPEPVVVMVDPIISSACDQQHNLPYEEESKNIDDHGSGNKWMSSKMRLMKKMMRPSMSPTTDKAINSGLESSSSRYSQRSLCNNNASSTTRVCSDCNTSTTPLWRSGPKGPKSLCNACGIRQRKARRAMTKATSGLITPITCAKTRVHNKEKKSRANHFAQFKNKYKSTTTTSAGSSEGVRKLEYLKDFAISLRSNNSDFEQGFPRDEVAEAALLLMDLSCGFVHL

SEQ ID NO: 5995 - protein, 370 aa, Zea mays
  misc_feature (1)..(370): useful for making plants with modified plant phenotypes as described in USSN 12/139,269
  misc_feature (1)..(370): Ceres CLONE ID no. 1536888
  misc_feature (1)..(370): Utility: Useful for delaying flowering time
  misc_feature (1)..(370): Utility: Useful for increasing chlorophyll and photosynthetic capacity
  misc_feature (1)..(370): Utility: Useful for increasing increasing anthocyanin content
  misc_feature (1)..(370): Utility: Useful for making plants with increased biomass and foliage
  misc_feature (1)..(370): Utility: Useful for making smaller plants
MSAIYMSQLSTALPLMEGDHQDHHHHHQGHFQAFTLPKETPILFPFVISNSSASEGSLSYGSAADHHLLRQRHQAMLEPQHMIGGSSTATGNSVFSTPFPTVESIRDDMIEPASYDPYDMGKLQVGGSMDACSWTPAAAKMRITRKATADPSAGKKPRRRAQAGYDDTMSGQPNLGVIRVCSDCNTTKTPLWRSGPCGPKSLCNACGIRQRKARRAMMAAASGSVSAVPTDSGKASPSNAAVAAAAAHPKVKKEKRVDVDRSLPFKKRCKVVQQGHGAAVVVAAPAAATDSATVVQATAEDGDDDTCPSRDLLVDDIGGLISWSRSPAAPASAAAATCSFRASPALSVQQDEITDAAMLLMTLSCGLVRS

SEQ ID NO: 5996 - DNA, 1257 bp, Arabidopsis thaliana
  misc_feature (1)..(1257): useful for making plants with modified plant phenotypes as described in USSN 12/139,269
  misc_feature (1)..(1257): Ceres CLONE ID no. 116257
  misc_feature (1)..(1257): Also known as  Ceres CDNA ID no. 23374085
agtataaagacgacaaagtaaaccaaaaaaaaaagagttctcctacaattttcctaaattcttggatttgagatttcactttttccgatttgaaacaatgatgataactcgcggtggagccaaggcggcgaaatcgctgttaatggcggctggaccacgtttgttctcgacggtccgtacggtttcgtctcacgaggctttatcagcaagccatattttgaagcctggtgttacatctgcttggatatggactagagctccgacgattggaggtatgagattcgctagcacgatcactctgggagagaaaactccgatgaaggaggaggacgcgaatcagaagaaaacagagaacgaatccaccggtggagacgccgccggaggtaataacaagggagataaaggaatcgcgagctattggggtgttgaacctaataagattactaaagaagatggttctgaatggaagtggaactgtttcaggccatgggagacgtataaagctgatatagatagatctgaagaagcatcatgttccaacgacgtttcttgatagaatagcttattggactgttaaatctcttcgttggcctaccgatttgttcttccagaggagatatggatgtcgagctatgatgcttgaaactgtagcagcagtacctggaatggttggaggaatgttactacactgcaaatcgcttcgacgttttgagcaaagtggaggatggattaaggctcttcttgaggaagcagagaatgagagaatgcatcttatgacattcatggaagtcgcgaaaccgaaatggtacgagagagcgctcgtgatcactgtgcaaggagtcttcttcaacgcttatttccttggttacttaatctctcccaagtttgctcatcgtatggttgggtaccttgaagaagaagcgatccattcttatactgagtttctcaaggaacttgacaaaggtaacattgagaatgttcctgctccggctattgctattgattactggaggcttcctgctgatgcgacacttcgtgatgttgtgatggttgttcgtgctgacgaggctcatcaccgtgatgtaaaccattttgcatctgatattcactaccaaggtcgtgaactaaaggaagctccagctccaattgggtatcattgattcgattaaaagaagagctttttctcaagtttaaaactttgttctaaagaatttaagttctttgacttgtatatacataatcacctctgcttaagct

SEQ ID NO: 5997 - protein, 175 aa, Arabidopsis thaliana
  misc_feature (1)..(175): useful for making plants with modified plant phenotypes as described in USSN 12/139,269
  misc_feature (1)..(173): Pfam Name: AOX; Pfam Description: Alternative oxidase
  misc_feature (1)..(175): Utility: Useful for delaying flowering time
  misc_feature (1)..(175): Utility: Useful for increasing chlorophyll and photosynthetic capacity
  misc_feature (1)..(175): Utility: Useful for making plants sterile and for genetic confinement
  misc_feature (1)..(175): Utility: Useful for making plants with increased biomass and foliage
  misc_feature (1)..(175): Utility: Useful for making stronger plants
MMLETVAAVPGMVGGMLLHCKSLRRFEQSGGWIKALLEEAENERMHLMTFMEVAKPKWYERALVITVQGVFFNAYFLGYLISPKFAHRMVGYLEEEAIHSYTEFLKELDKGNIENVPAPAIAIDYWRLPADATLRDVVMVVRADEAHHRDVNHFASDIHYQGRELKEAPAPIGYH

SEQ ID NO: 5998 - protein, 325 aa, Arabidopsis thaliana
  misc_feature (1)..(325): useful for making plants with modified plant phenotypes as described in USSN 12/139,269
  misc_feature (1)..(325): Public GI no. 2506082
  misc_feature (1)..(325): Utility: Useful for delaying flowering time
  misc_feature (1)..(325): Utility: Useful for increasing chlorophyll and photosynthetic capacity
  misc_feature (1)..(325): Utility: Useful for making plants sterile and for genetic confinement
  misc_feature (1)..(325): Utility: Useful for making plants with increased biomass and foliage
  misc_feature (1)..(325): Utility: Useful for making stronger plants
MMMSRRYGAKLMETAVTHSHLLNPRVPLVTENIRVPAMGVVRVFSKMTFEKKKTTEEKGSSGGKADQGNKGEQLIVSYWGVKPMKITKEDGTEWKWSCFRPWETYKSDLTIDLKKHHVPSTLPDKLAYWTVKSLRWPTDLFFQRRYGCRAMMLETVAAVPGMVGGMLVHCKSLRRFEQSGGWIKALLEEAENERMHLMTFMEVAKPNWYERALVIAVQGIFFNAYFLGYLISPKFAHRMVGYLEEEAIHSYTEFLKELDNGNIENVPAPAIAIDYWRLEADATLRDVVMVVRADEAHHRDVNHYASDIHYQGRELKEAPAPIGYH

SEQ ID NO: 5999 - protein, 320 aa, Glycine max
  misc_feature (1)..(320): useful for making plants with modified plant phenotypes as described in USSN 12/139,269
  misc_feature (1)..(320): Ceres CLONE ID no. 604415
  misc_feature (1)..(320): Utility: Useful for delaying flowering time
  misc_feature (1)..(320): Utility: Useful for increasing chlorophyll and photosynthetic capacity
  misc_feature (1)..(320): Utility: Useful for making plants sterile and for genetic confinement
  misc_feature (1)..(320): Utility: Useful for making plants with increased biomass and foliage
  misc_feature (1)..(320): Utility: Useful for making stronger plants
MMMMSRSGANRVANTAMFVAKGLSGEVGGLRALYGGGVRSESTLALSEKEKIEKKVGLSSAGGNKEEKVIVSYWGIQPSKITKKDGTEWKWNCFRPWETYKADLSIDLEKHHAPTTFLDKMAFWTVKVLRYPTDVFFQRRYGCRAMMLETVAAVPGMVAGMLLHCKSLRRFEHSGGWIKALLEEAENERMHLMTFMEVAKPKWYERALVITVQGVFFNAYFLGYLLSPKFAHRMVGYLEEEAIHSYTEFLKELDKGNIENVPAPAIAIDYWQLPPGSTLRDVVMVVRADEAHHRDVNHFASDIHYQGRELREAAAPIGYH

SEQ ID NO: 6000 - protein, 321 aa, Glycine max
  misc_feature (1)..(321): useful for making plants with modified plant phenotypes as described in USSN 12/139,269
  misc_feature (1)..(321): Public GI no. 395216
  misc_feature (1)..(321): Utility: Useful for delaying flowering time
  misc_feature (1)..(321): Utility: Useful for increasing chlorophyll and photosynthetic capacity
  misc_feature (1)..(321): Utility: Useful for making plants sterile and for genetic confinement
  misc_feature (1)..(321): Utility: Useful for making plants with increased biomass and foliage
  misc_feature (1)..(321): Utility: Useful for making stronger plants
MMMMMSRSGANRVANTAMFVAKGLSGEVGGLRALYGGGVRSESTLALSEKEKIEKKVGLSSAGGNKEEKVIVSYWGIQPSKITKKDGTEWKWNCFSPWGTYKADLSIDLEKHMPPTTFLDKMAFWTVKVLRYPTDVFFQRRYGCRAMMLETVAAVPGMVAGMLLHCKSLRRFEHSGGWFKALLEEAENERMHLMTFMEVAKPKWYERALVITVQGVFFNAYFLGYLLSPKFAHRMFGYLEEEAIHSYTEFLKELDKGNIENVPAPAIAIDYWQLPPGSTLRDVVMVVRADEAHHRDVNHFASDIHYQGRELREAAAPIGYH

SEQ ID NO: 6001 - protein, 328 aa, Zea mays
  misc_feature (1)..(328): useful for making plants with modified plant phenotypes as described in USSN 12/139,269
  misc_feature (1)..(328): Ceres CLONE ID no. 292667
  misc_feature (1)..(328): Utility: Useful for delaying flowering time
  misc_feature (1)..(328): Utility: Useful for increasing chlorophyll and photosynthetic capacity
  misc_feature (1)..(328): Utility: Useful for making plants sterile and for genetic confinement
  misc_feature (1)..(328): Utility: Useful for making plants with increased biomass and foliage
  misc_feature (1)..(328): Utility: Useful for making stronger plants
MSSRAGSILLRHAGSRLFTAAAISPAAASRPLLAGGNGVPAVMLRLMSTSSPAAPTEAKDEAAKASKVGGDKKAVVINSYWGIEQNNKLARDDGTEWKWTCFRPWETYTADTSIDLTRHYEPKTLMDKVAYWTVKSLRFPTDIFFQRRYGCRAMMLETVAAVPGMVGGMLLHLRSLRRFEQSGGWIRALLEEAENERMHLMTFMEVAKPRWYERALVITVQGVFFNAYFLGYLLSPKFAHRVVGYLEEEAIHSYTEYLKDLEAGKIENVPAPAIAIDYWRLPANATLKDVVTVVRADEAHHRDVNHFASDIHCQGMQLKQSPAPIGYH

SEQ ID NO: 6002 - protein, 332 aa, Triticum aestivum
  misc_feature (1)..(332): useful for making plants with modified plant phenotypes as described in USSN 12/139,269
  misc_feature (1)..(332): Ceres CLONE ID no. 569711
  misc_feature (1)..(332): Utility: Useful for delaying flowering time
  misc_feature (1)..(332): Utility: Useful for increasing chlorophyll and photosynthetic capacity
  misc_feature (1)..(332): Utility: Useful for making plants sterile and for genetic confinement
  misc_feature (1)..(332): Utility: Useful for making plants with increased biomass and foliage
  misc_feature (1)..(332): Utility: Useful for making stronger plants
MAGSVLLRRAGAGASRLFATTPSPAARAVLGGGEGAWVRLMSTSAASQVKDEAAKAVKAEAAKAVKAEAAKGDGEKKEVAISSYWGIEQSKKLVREDGTEWKWSCFRPWETYTADTSIDLTKHHVPNTMLDKIAYYTVKSLRFPTDIFFQRRYGCRAMMLETVAAVPGMVGGMLLHLRSLRRFEQSGGWIRALLEEAENERMHLMTFMEVAQPRWYERALVIAVQGVFFNAYFFGYLISPKFAHRVVGYLEEEAVHSYTEFLKDLDDGKIDNVPAPAIAIDYWRLPANATLKDVVTVVRADEAHHRDVNHFASDVYYQGMQLKATPAPIGYH

SEQ ID NO: 6003 - protein, 324 aa, Triticum aestivum
  misc_feature (1)..(324): useful for making plants with modified plant phenotypes as described in USSN 12/139,269
  misc_feature (1)..(324): Ceres CLONE ID no. 780669
  misc_feature (1)..(324): Utility: Useful for delaying flowering time
  misc_feature (1)..(324): Utility: Useful for increasing chlorophyll and photosynthetic capacity
  misc_feature (1)..(324): Utility: Useful for making plants sterile and for genetic confinement
  misc_feature (1)..(324): Utility: Useful for making plants with increased biomass and foliage
  misc_feature (1)..(324): Utility: Useful for making stronger plants
MAGSVLLRRAGAGAGRLFATTASPAARTALGGGGGAWVRMMSTSAASQVKDEAAKGVKAEAAKGDGEKKEVAISSYWGIDQSKKLVREDGTEWKWSCFRPWETYTADTSIDLTKHHVPNTMLDKIAYYTVKSLRFPTDIFFQRRYGCRAMMLETVAAVPGMVGGMLLHLRSLRRFEQSGGWIRALLEEAENERMHLMTFMEVAQPRWYERALVIAVQGVFFNAYFFGYLISPKFAHRVVGYLEEEAVHSYTEFLKDLDDGKIDNVPAPAIAIDYWRLPANATLKDVVTVVRADEAHHRDVNHFASDVYYQGMQLKATPAPIGYH

SEQ ID NO: 6004 - protein, 328 aa, Zea mays
  misc_feature (1)..(328): useful for making plants with modified plant phenotypes as described in USSN 12/139,269
  misc_feature (1)..(328): Ceres CLONE ID no. 322131
  misc_feature (1)..(328): Utility: Useful for delaying flowering time
  misc_feature (1)..(328): Utility: Useful for increasing chlorophyll and photosynthetic capacity
  misc_feature (1)..(328): Utility: Useful for making plants sterile and for genetic confinement
  misc_feature (1)..(328): Utility: Useful for making plants with increased biomass and foliage
  misc_feature (1)..(328): Utility: Useful for making stronger plants
MAGAALLRHLGPRLFAAGPAVSGLTARGGMPAAARLLPARMASTAAEAAREDAGANKRHGGTEKHEEEAAGGQSKKAVVSYWGIDTPKLVKEDGTEWKWTSFRPWDAYTSDTSIDIGKHHAPTTLPDKAAYLIVKSLHVPMDLFFQRRHASHALLLETVAAVPGMVGGMLLHLRSLRRFEHSGGWIRALLEEAENERMHLMTFLEVTQPRWWERALVLTAQGVFFNAYFVGYLLSPKFAHRVVGYLEEEAVHSYTEYLKDLEAGIIDNTPAPAIAIDYWRLPADAKLKDVVTVVRADEAHHRDVNHFASVRTLHLATGFIAVSNLQQF

SEQ ID NO: 6005 - protein, 303 aa, Glycine max
  misc_feature (1)..(303): useful for making plants with modified plant phenotypes as described in USSN 12/139,269
  misc_feature (1)..(303): Ceres CLONE ID no. 544846
  misc_feature (1)..(303): Utility: Useful for delaying flowering time
  misc_feature (1)..(303): Utility: Useful for increasing chlorophyll and photosynthetic capacity
  misc_feature (1)..(303): Utility: Useful for making plants sterile and for genetic confinement
  misc_feature (1)..(303): Utility: Useful for making plants with increased biomass and foliage
  misc_feature (1)..(303): Utility: Useful for making stronger plants
MPYAAAETRLLCAGGANGWFFYWKRTMVSPAEAKVPEKEKEKEKAKAEKSVVESSYWGISRPKVVREDGTEWPWNCFMPWESYRSNVSIDLTKHHVPKNVLDKVAYRTVKLLRIPTDLFFKRRYGCRAMMLETVAAVPGMVGGMLLHLRSLRKFQQSGGWIKALLEEAENERMHLMTMVELVKPKWYERLLVLAVQGVFFNAFFVLYILSPKVAHRIVGYLEEEAIHSYTEYLKDLESGAIENVPAPAIAIDYWRLPKDARLKDVITVIRADEAHHRDVNHFASDIHFQGKELREAPAPIGYH

SEQ ID NO: 6006 - DNA, 1425 bp, Arabidopsis thaliana
  misc_feature (1)..(1425): useful for making plants with modified plant phenotypes as described in USSN 12/139,269
  misc_feature (1)..(1425): Ceres CLONE ID no. 116843
  misc_feature (1)..(1425): Also known as  Ceres CDNA ID no. 23374523
aatggcgtcgacgaagcccgattccgcaatcaaccttgaagaagaggctgaaggcgacggtgtagccgtagacgatccgattttcataccggagaccacgaacttactcgtccgttactcgccattcgacgacagggacatcgattgcaatccttatttccctttcacaggcccgatttcagattctggatcaggttcttactcggattctgagcccgatcccaacagctgtcccatcgatttcttcgatcgagattcttccgatgttgacgtggctgagtacttggaatcaggagggctgaccgccggtgattataatatttggggcttttatgaccccaaggaagacgaggaagaggaggagatagttttggggacttccgggtcggatctgcaaccgggtgattcaggggagcaagggcttcgagtgaccggtatcgattcagattccgattgtgaagatggcgtgtttgattttatctctgaggatagtagcgggaataggggaaatgattcgggtcgggtcgaggttggtacgggtcttcctcctgtgtgggatcatctcttcggagagggaaccgtgttggctgatgaagaatgggaggaggtgcagaacgcgattaactggacagcttttagtggacccgaagatgaggacgaagaagatgaattgtcttcactatcaagggatgatgaagaagaagatcatgaactggactggcaggttttgttaactgttaacaatgttgttaattatatcgaacaagctgaaggaatcatgctaaatcctgatgatatcgatccggattattacctgtatctatctggtttggatgaatttgatgaaaatcagagtggacattatgatgctgatgctattcttgggcaaatgtttgatgacgagactggaatcaggggaaatcctccagcagccaaaagtgtaattcaggatcttccggttgtggagcttgctgtggaagagttagacaaagggaacaatgtttgtgcggtatgcaaagatgaaatgttagtggaggagaaagtaaggaggcttccttgtagtcatttctatcatggagagtgtatcataccttggttggggataaggaatacttgcccggtttgtcggtatgagctgcctactgatgatcttgagtatgaaagacataagagctcagaaaggggcgatactggtttggcaaggaacgtgttgccgggtagatatagttaattgaatatttgaagtgatctattcttcaagttaatagacatggtttcagaggcaagatccttgaaccactttgtttatggtaagcacttatcgtgaatgtgataatgtttaagttgtatatattccttttgttttgtgaaataaatcatgttaaactttgaacccttatcttgaagtgtttgtgaagttaattc

SEQ ID NO: 6007 - protein, 409 aa, Arabidopsis thaliana
  misc_feature (1)..(409): useful for making plants with modified plant phenotypes as described in USSN 12/139,269
  misc_feature (335)..(375): Pfam Name: zf-C3HC4; Pfam Description: Zinc finger, C3HC4 type (RING finger)
  misc_feature (1)..(409): Utility: Useful for delaying flowering time
  misc_feature (1)..(409): Utility: Useful for making ornamental plants with modified flowers
  misc_feature (1)..(409): Utility: Useful for making plants sterile and for genetic confinement
  misc_feature (1)..(409): Utility: Useful for making smaller plants
  misc_feature (1)..(409): Utility: Useful for modifying plant architecture, ie amount of branching
MASTKPDSAINLEEEAEGDGVAVDDPIFIPETTNLLVRYSPFDDRDIDCNPYFPFTGPISDSGSGSYSDSEPDPNSCPIDFFDRDSSDVDVAEYLESGGLTAGDYNIWGFYDPKEDEEEEEIVLGTSGSDLQPGDSGEQGLRVTGIDSDSDCEDGVFDFISEDSSGNRGNDSGRVEVGTGLPPVWDHLFGEGTVLADEEWEEVQNAINWTAFSGPEDEDEEDELSSLSRDDEEEDHELDWQVLLTVNNVVNYIEQAEGIMLNPDDIDPDYYLYLSGLDEFDENQSGHYDADAILGQMFDDETGIRGNPPAAKSVIQDLPVVELAVEELDKGNNVCAVCKDEMLVEEKVRRLPCSHFYHGECIIPWLGIRNTCPVCRYELPTDDLEYERHKSSERGDTGLARNVLPGRYS

SEQ ID NO: 6008 - protein, 131 aa, Arabidopsis thaliana
  misc_feature (1)..(131): useful for making plants with modified plant phenotypes as described in USSN 12/139,269
  misc_feature (1)..(131): Public GI no. 4651204
  misc_feature (1)..(131): Utility: Useful for delaying flowering time
  misc_feature (1)..(131): Utility: Useful for making ornamental plants with modified flowers
  misc_feature (1)..(131): Utility: Useful for making plants sterile and for genetic confinement
  misc_feature (1)..(131): Utility: Useful for making smaller plants
  misc_feature (1)..(131): Utility: Useful for modifying plant architecture, ie amount of branching
ERGVGLEHEDENIADLYLAVQDGIISGTTDYDILFGQLLENESGLKGSPPTAKSFVENLPLVELTEEELKGKDIVCAVCKDEVMLEEKVRKLPCSHCYHGDCILPWLSIRNTCPVCRFELPTDDADYERSK

SEQ ID NO: 6009 - protein, 298 aa, Zea mays
  misc_feature (1)..(298): useful for making plants with modified plant phenotypes as described in USSN 12/139,269
  misc_feature (1)..(298): Ceres CLONE ID no. 299434
  misc_feature (1)..(298): Utility: Useful for delaying flowering time
  misc_feature (1)..(298): Utility: Useful for making ornamental plants with modified flowers
  misc_feature (1)..(298): Utility: Useful for making plants sterile and for genetic confinement
  misc_feature (1)..(298): Utility: Useful for making smaller plants
  misc_feature (1)..(298): Utility: Useful for modifying plant architecture, ie amount of branching
MADFGDELFLDVGDDGFGDLSYVSFSESIELDLACPRDVFSAGFDPETLTHIPGSPISFDSDPDLRHLSPSLTCSPPFWDCLDDAASFEWEEIADAALGVGGGAGGAGGGGQGLEGDADADADVFGFLDEREMLGVMEGIDSGDDDSIFSDEPPFDFGDGDTELEGIFRSGVGWELLPVPLDEDEFEVLPGHVVEVGGAPPAARAVVERLQVVAVRGEEVVQECAVCKEGMEQGELTTGLPCGHFYHGACIGPWLAIRNTCPVCRYELPTDDPEYEKRRARRHSAGGSTPQLGAPMQV

SEQ ID NO: 6010 - protein, 271 aa, Zea mays
  misc_feature (1)..(271): useful for making plants with modified plant phenotypes as described in USSN 12/139,269
  misc_feature (1)..(271): Public GI no. 50947067
  misc_feature (1)..(271): Utility: Useful for delaying flowering time
  misc_feature (1)..(271): Utility: Useful for making ornamental plants with modified flowers
  misc_feature (1)..(271): Utility: Useful for making plants sterile and for genetic confinement
  misc_feature (1)..(271): Utility: Useful for making smaller plants
  misc_feature (1)..(271): Utility: Useful for modifying plant architecture, ie amount of branching
MASSSLLVRLASDEMPQTLDASSSSSCYDAFVPVFHPDPSSGFSAASVVAAADRLRSQFLSVEPDLFHDALVAPSPDHLGFPDEEEEEEIRWDCLQLDDDDEEEEGVADLRLEASNAAEEFDWEEVASPSGGAGMDQPEPEWEVLADVPPPPPPPADEGFVYTSDRDVYEVLVGEGLFLKSKPPAARSAVEALPSAVVAAGEDGEGEECAVCRDGVAAGERVKRLPCSHGYHEECIMPWLDVRNSCPLCRFELPTDDPQYESWKASRAAAA

SEQ ID NO: 6011 - DNA, 1669 bp, Arabidopsis thaliana
  misc_feature (1)..(1669): useful for making plants with modified plant phenotypes as described in USSN 12/139,269
  misc_feature (1)..(1669): Ceres CLONE ID no. 119256
  misc_feature (1)..(1669): Also known as  Ceres CDNA ID no. 23375558
atttctaatatctctttccatttcttgaaatggtcctcctctcaccttaactttataagaatctgaccacctctcaggtttccagtttcttcactttctcgttctctggacactgaatgtgatacatatatagaagaagaaagctataagagattgatcgatggaggtgaatgttcttgcatccaagagaagtcttctcctttttcttcttattgtaagtctctctttgagccagaaggtcagacatatctctgcctttaacgacaccaaaccatacagacaagtcagtagcttgagacttgcgaggatccaaaagcacttgaacaagatcaacaagtctcctgtcttcaccattcagagtccagatggtgatgtaatagattgtgtacccaaaagaaagcagccagctttggatcatccactcttaaagcatcacaagattcagaaagcaccgaagaaaatgccgaagatgaagggaaaagatgatgatgttaaagaagcagagaatgtattggaaggtgcatggcaaatgtggcacgtgaacggcacgaggtgccctaaggggaccgttcccatacgacgcaacacaatgaacgatgtgctcagagccaagtctttgtttgactttggcaaaaagcgacggagtatttaccttgatcaacggacagaaaagcctgatgcccttggtaccaatggacatgagcatgcgatcgcttatacagaatcatcgtcggagatatatggagcaaaggcgactataaacgtttgggatccaaagatagaagaagtgaatgagtttagtctctctcagatttggattctttctggatctttcgtaggtcctgatctcaatagtattgaagctggctggcaggtcagtccggagctgtatggtgacaacagaccaagattgttcacttattggacgagtgattcatatcaagcaacaggatgttacaatcttctatgttcgggatttatccaaacaaataacaagattgccattggagcagccatatctcctctttctactttcaaaggaaaccagtttgatatcacaatactcatttggaaggatccgaaaatggggaattggtggatgggtttaggggatagcacactagtcgggtattggccagccgagctattcacgcacttggccgaccacgcgactaccgtggaatggggcggtgaagtcgtcaacacacgtgcttcaggcaggcacacgacgacccaaatgggctctggtcattttccagacgaagggtttgggaaagcaagttattttcggaatttggaagttgtggattcggacaacagtctcgtaccggtgcatgatgtcaagatactagccgagaacaccgaatgttacgacattaagagttcgtatagtaatgaatggggaacttatttttactatggtgggccggggtttaatcctaggtgtaattgaaattaaagtgtacatagttcgggttggaggagtggaggaaaaaaaagagggggtcgaaatatgtaatttttttcaagtatgggtagtgaaagattgaatattggcttattgtttttgatttgtcatattgttggttgaaatctagtaatttattgccctcataggaaaaagaagtgtgtatgcaataatgaaagtatgagacaattttttctttgc

SEQ ID NO: 6012 - protein, 430 aa, Arabidopsis thaliana
  misc_feature (1)..(430): useful for making plants with modified plant phenotypes as described in USSN 12/139,269
  misc_feature (193)..(388): Pfam Name: DUF239; Pfam Description: Arabidopsis proteins of unknown function
  misc_feature (1)..(430): Utility: Useful for delaying flowering time
  misc_feature (1)..(430): Utility: Useful for increasing chlorophyll and photosynthetic capacity
  misc_feature (1)..(430): Utility: Useful for making plants sterile and for genetic confinement
  misc_feature (1)..(430): Utility: Useful for making plants with increased biomass and foliage
  misc_feature (1)..(430): Utility: Useful for making smaller plants
MEVNVLASKRSLLLFLLIVSLSLSQKVRHISAFNDTKPYRQVSSLRLARIQKHLNKINKSPVFTIQSPDGDVIDCVPKRKQPALDHPLLKHHKIQKAPKKMPKMKGKDDDVKEAENVLEGAWQMWHVNGTRCPKGTVPIRRNTMNDVLRAKSLFDFGKKRRSIYLDQRTEKPDALGTNGHEHAIAYTESSSEIYGAKATINVWDPKIEEVNEFSLSQIWILSGSFVGPDLNSIEAGWQVSPELYGDNRPRLFTYWTSDSYQATGCYNLLCSGFIQTNNKIAIGAAISPLSTFKGNQFDITILIWKDPKMGNWWMGLGDSTLVGYWPAELFTHLADHATTVEWGGEVVNTRASGRHTTTQMGSGHFPDEGFGKASYFRNLEVVDSDNSLVPVHDVKILAENTECYDIKSSYSNEWGTYFYYGGPGFNPRCN

SEQ ID NO: 6013 - protein, 306 aa, Zea mays
  misc_feature (1)..(306): useful for making plants with modified plant phenotypes as described in USSN 12/139,269
  misc_feature (1)..(306): Ceres CLONE ID no. 324710
  misc_feature (1)..(306): Utility: Useful for delaying flowering time
  misc_feature (1)..(306): Utility: Useful for increasing chlorophyll and photosynthetic capacity
  misc_feature (1)..(306): Utility: Useful for making plants sterile and for genetic confinement
  misc_feature (1)..(306): Utility: Useful for making plants with increased biomass and foliage
  misc_feature (1)..(306): Utility: Useful for making smaller plants
MLQMWHRNGRCPEGTVPIRRTKKDDLLRASSVRRYGRKRHTAPNPLSVDPNMLSEGGHQHAIAYVQGDKYYGAKATINVWEPKIQQANEFSLSQLWILGGSFGEDLNSIEAGWQVSPDLYGDNNTRLFTYWTSDAYQATGCYNMLCSGFIQINSEVAMGASIFPISNYAGSQYDISILIWKDPKEGNWWMQFGKEYVLGYWPSFLFSYLADSASMIEWGGEVVNSEPDGTHTSTQMGSGHFPEEGFSKASYFKNVQVVYSSNQLSAPKGVGTFTEQSNCYDVQNGNNGDWGTYFYYGGPGKNSNCP

SEQ ID NO: 6014 - protein, 408 aa, Zea mays
  misc_feature (1)..(408): useful for making plants with modified plant phenotypes as described in USSN 12/139,269
  misc_feature (1)..(408): Public GI no. 50935081
  misc_feature (1)..(408): Utility: Useful for delaying flowering time
  misc_feature (1)..(408): Utility: Useful for increasing chlorophyll and photosynthetic capacity
  misc_feature (1)..(408): Utility: Useful for making plants sterile and for genetic confinement
  misc_feature (1)..(408): Utility: Useful for making plants with increased biomass and foliage
  misc_feature (1)..(408): Utility: Useful for making smaller plants
MAAAWVLAAAAALALWAAAAEGARSPAARVHRHLKRLNKPAVKSIESPDGDIIDCVHLSHQPAFDHPLLKNHTLQMRPAYHPEGLYDDDKRSVASDNAGEKPMLQLWHQKGRCPEGTVPIRRTKKDDLLRASSLRRYGRKRHTAVNPLSIDPNMLNEGGHQHAIAYVEGDKYYGAKATINVWEPKIQQPNEFSLSQLWILGGSFGEDLNSIEAGWQVSPDLYGDNNTRLFTYWTSDAYQATGCYNILCSGFIQINSEIAMGASIFPISNIAGSQYDISILIWKDPKEGNWWMQFGREYVLGYWPSFLFSYLVDSASMVEWGGEVVNSEPDGTHTSTQMGSGRFPEEGFGKASYFKNIQVVDSSNQLKAPKGVGTYTEQSNCYDVQNGNNGDWGTYFYYGGPGKNSNCP

SEQ ID NO: 6015 - protein, 428 aa, Zea mays
  misc_feature (1)..(428): useful for making plants with modified plant phenotypes as described in USSN 12/139,269
  misc_feature (1)..(428): Ceres CLONE ID no. 403558
  misc_feature (1)..(428): Utility: Useful for delaying flowering time
  misc_feature (1)..(428): Utility: Useful for increasing chlorophyll and photosynthetic capacity
  misc_feature (1)..(428): Utility: Useful for making plants sterile and for genetic confinement
  misc_feature (1)..(428): Utility: Useful for making plants with increased biomass and foliage
  misc_feature (1)..(428): Utility: Useful for making smaller plants
MAAARACFVALALVAALFVAGSAAAAAGNAGGRSQLTLRQRRRQLLRQRQVRSHLKRLNKAPLATIESPDGDIIDCVHISNQPALDHPFLKNHTVQMRPAYHPEGLYDDESKVASQRNAQTITQMWHQNGRCPEGTIPIRRTKEEDVLRASSVRRYGKKKRRSAPNPMSVDPDMLNESGHQHAIAYVEGDKYYGAKATINVWQPKIEQANEFSLSQLWILGGSFGQDLNSIEAGWQVSPDLYGDNNTRLFTYWTSDAYQATGCYNLLCSGFIQINNQIAMGASIFPISNYGGSQYDINILVWKDPKEGNWWLQFGNDYVLGYWPSFLFSYLADSASMIEWGGEVVNSEPDGSHTSTQMGSGHFPEEGFGKASYFRNVQVVDSTNNLKAPRGVGTFTEQSSCYDVQDGSNADWGTYFYYGGPGKNSNCP

SEQ ID NO: 6016 - protein, 418 aa, Glycine max
  misc_feature (1)..(418): useful for making plants with modified plant phenotypes as described in USSN 12/139,269
  misc_feature (1)..(418): Ceres CLONE ID no. 473726
  misc_feature (1)..(418): Utility: Useful for delaying flowering time
  misc_feature (1)..(418): Utility: Useful for increasing chlorophyll and photosynthetic capacity
  misc_feature (1)..(418): Utility: Useful for making plants sterile and for genetic confinement
  misc_feature (1)..(418): Utility: Useful for making plants with increased biomass and foliage
  misc_feature (1)..(418): Utility: Useful for making smaller plants
MGSSCGCGVTLVLVFCLWGVLISLSSAARLSASRQKLEVAKHLNRLNKPPVKTIQSPDGDTIDCVPISKQPAFDHPFLKDHKIQTRPSFHPEGLFEENKLSEKPDAKTHTPITQLWHANGRCPEDTIPVRRAKEEDVLRASSVKRYGRKKHRAIPKPRSAEPDLINQSGHQHAIAYVEGDKYYGAKATLNVWEPRIQQPNEFSLSQLWILGGSFGQDLNSIEAGWQVSPDLYGDNNTRLFTYWTSDAYQATGCYNLLCSGFIQVNSEIAMGATISPVSAYRNSQFDISILIWKDPKEGHWWMQFGNDYVLGYWPSFLFSYLADSASMIEWGGEVVNSEPDGQHTSTQMGSGHFPEEGFGKASYFRNIQVVDSSNNLKAPKGIGTFTEQSNCYDVQTGSNGDWGHYFYYGGPGKNPNCQ

SEQ ID NO: 6017 - protein, 419 aa, Triticum aestivum
  misc_feature (1)..(419): useful for making plants with modified plant phenotypes as described in USSN 12/139,269
  misc_feature (1)..(419): Ceres CLONE ID no. 847500
  misc_feature (1)..(419): Utility: Useful for delaying flowering time
  misc_feature (1)..(419): Utility: Useful for increasing chlorophyll and photosynthetic capacity
  misc_feature (1)..(419): Utility: Useful for making plants sterile and for genetic confinement
  misc_feature (1)..(419): Utility: Useful for making plants with increased biomass and foliage
  misc_feature (1)..(419): Utility: Useful for making smaller plants
MAAPYSPSPSPSHPTAAALVLLLLLLHVALLGKCAAAANVTFRPGEELRRYRRVQALLTRLNKPSLRTIQSPDGDLIDCVPAHLQPAFDYPRLRGQRPLGPPVRPSGHHRRPNHTADVGVQLWAVSGASCPEGSVPVRRITEADVLRASSVRRFGRVPMARVRRDTVAGGHEHAVGYVAGDEYYGARASINVWAPKVSTPTEFSLSQIWVIGGTFGNDLNTIEAGWQVSPQLYGDNSPRFFTYWTTDAYQTTGCYNLLCSGFVQTNSRIAMGAAISPTSGYKGGQFDISLLIWKDPNHGNWWLEFGSGELVGYWPSFLFSHLASHASMVQFGGKVVDTRAEGSHTATQMGSGHFPGEGFGRSSYFRNLEVVDWDNSLIPLTTFHVTADHPNCYDIQGGVNAVWGNYFYYGGPGRNVRCT

SEQ ID NO: 6018 - protein, 430 aa, Triticum aestivum
  misc_feature (1)..(430): useful for making plants with modified plant phenotypes as described in USSN 12/139,269
  misc_feature (1)..(430): Public GI no. 50938543
  misc_feature (1)..(430): Utility: Useful for delaying flowering time
  misc_feature (1)..(430): Utility: Useful for increasing chlorophyll and photosynthetic capacity
  misc_feature (1)..(430): Utility: Useful for making plants sterile and for genetic confinement
  misc_feature (1)..(430): Utility: Useful for making plants with increased biomass and foliage
  misc_feature (1)..(430): Utility: Useful for making smaller plants
MAAAAAARRGCLVALLAVLFLACAAEGGAAAASAAQQQQQLRRRRHLLRRQRQVHSHLRRLNKAPLASIESPDGDIIDCVHISNQPAFDHPFLKNHTIQMRPDYHPEGLYDESKVASQQNTQTITQMWHKNGVCPENTIPIRRTKKEDVLRASSIRRYGKKKHKSTPNPMSVDPDMLNESGHQHAIAYVEGDKYYGAKATINVWQPRIEQANEFSLSQLWILGGSFGQDLNSIEAGWQVSPDLYGDNNTRLFTYWTSDAYQATGCYNLLCSGFIQINNQIAMGASISPLSNYGGSQYDINILVWKDPKEGNWWLQFGNDYVLGYWPSFLFSYLADSASMIEWGGEVVNSEPDGSHTSTQMGSGHFPEEGFGKSSYFKNIQVVDSSNNLRAPSGIGSFTEQSNCYDVQNGNNGDWGTYFYYGGPGKNPNCP

SEQ ID NO: 6019 - DNA, 1385 bp, Arabidopsis thaliana
  misc_feature (1)..(1385): useful for making plants with modified plant phenotypes as described in USSN 12/139,269
  misc_feature (1)..(1385): Ceres CLONE ID no. 123905
  misc_feature (1)..(1385): Also known as  Ceres CDNA ID no. 23449548
gaaaacaaaaacacaaacaaaactcatattttcaatctccaggtgctttacaccaacagagtcgcaagaaaacaaaaaccaaactcggatttagtttgacagaagaaggaatcgagagtcgggtatgcattatcctaacaacagaaccgaattcgtcggagctccagccccaacccggtatcaaaaggagcagttgtcaccggagcaagagctttcagttattgtctctgctttgcaacacgtgatctcaggggaaaacgaaacggcgccgtgtcagggtttttccagtgacagcacagtgataagcgcgggaatgcctcggttggattcagacacttgtcaagtctgtaggatcgaaggatgtctcggctgtaactactttttcgcgccaaatcagagaattgaaaagaatcatcaacaagaagaagagattactagtagtagtaacagaagaagagagagctctcccgtggcgaagaaagcggaaggtggcgggaaaatcaggaagaggaagaacaagaagaatggttacagaggagttaggcaaagaccttggggaaaatttgcagctgagatcagagatcctaaaagagccacacgtgtttggcttggtactttcgaaaccgccgaagatgcggctcgagcttatgatcgagccgcgattggattccgtgggccaagggctaaactcaacttcccctttgtggattacacgtcttcagtttcatctcctgttgctgctgatgatataggagcaaatgcaagtgcaagcgccagtgtgagcgccacagattcagttgaagcagagcaatggaacggaggaggaggggattgcaatatggagtggatgaatatgatgatgatgatggattttgggaatggagattcttcagattcaggaaatacaattgctgatatgttccagtgataaatgagctctttcttgttggcgttttttggagttaagtgcaagaagagattgacactgtggcttgtttaaagtgaacaagaacaagaaagcatgtaattagtagtctcattcttttgtttgtggtcaattctatgtttatctcatataaaatctgagttaaacctatctgaggagagagtaaataaagaggttaagaaacccaacattggtctgaattataaacgtaagtgtcaacgttgtttataaaggagaaaactataattggtgacaaaagacataaagaaaagatgtctactcctacaaagcatcgcgtgcagctattcgacaaacaatggcatctcccagagaggaaattccgagctcttggctagttatcttgtaatgctgaaaacatgaatgtatttgagtttatttctgtaacattggaagcgaaataaaagggttatcaactgtt

SEQ ID NO: 6020 - protein, 267 aa, Arabidopsis thaliana; identical to SEQ ID NO: 5245
  misc_feature (1)..(267): useful for making plants with modified plant phenotypes as described in USSN 12/139,269
  misc_feature (134)..(197): Pfam Name: AP2; Pfam Description: AP2 domain
  misc_feature (1)..(267): Utility: Useful for delaying flowering time
  misc_feature (1)..(267): Utility: Useful for increasing chlorophyll and photosynthetic capacity
  misc_feature (1)..(267): Utility: Useful for making larger plants
  misc_feature (1)..(267): Utility: Useful for making ornamental plants with modified flowers
  misc_feature (1)..(267): Utility: Useful for making ornamental plants with modified leaves
  misc_feature (1)..(267): Utility: Useful for making plants sterile and for genetic confinement
  misc_feature (1)..(267): Utility: Useful for making plants with altered leaf shape eg curled leaves
  misc_feature (1)..(267): Utility: Useful for making plants with enhanced plant architecture
  misc_feature (1)..(267): Utility: Useful for making plants with increased biomass
  misc_feature (1)..(267): Utility: Useful for making plants with increased biomass and foliage
  misc_feature (1)..(267): Utility: Useful for making smaller plants
  misc_feature (1)..(267): Utility: Useful for modifying plant structure, ie increased branching

SEQ ID NO: 6021 - protein, 214 aa, Zea mays
  misc_feature (1)..(214): useful for making plants with modified plant phenotypes as described in USSN 12/139,269
  misc_feature (1)..(214): Ceres CLONE ID no. 392659
  misc_feature (1)..(214): Utility: Useful for delaying flowering time
  misc_feature (1)..(214): Utility: Useful for increasing chlorophyll and photosynthetic capacity
  misc_feature (1)..(214): Utility: Useful for making larger plants
  misc_feature (1)..(214): Utility: Useful for making ornamental plants with modified flowers
  misc_feature (1)..(214): Utility: Useful for making ornamental plants with modified leaves
  misc_feature (1)..(214): Utility: Useful for making plants sterile and for genetic confinement
  misc_feature (1)..(214): Utility: Useful for making plants with altered leaf shape eg curled leaves
  misc_feature (1)..(214): Utility: Useful for making plants with enhanced plant architecture
  misc_feature (1)..(214): Utility: Useful for making plants with increased biomass
  misc_feature (1)..(214): Utility: Useful for making plants with increased biomass and foliage
  misc_feature (1)..(214): Utility: Useful for making smaller plants
  misc_feature (1)..(214): Utility: Useful for modifying plant structure, ie increased branching
MAAPRLERGGFQLPNTEQENSLFLRALISVVSGDTAALLPEAAAVEAPAAPVACARCGADGCAAAGCCELVAGSSSDSDGGLGLAAGKRRGRGRKVIQYRGVRRRPWGKWAAEIRDPRRAARKWLGTFDTAEDAARAYDVAAVELRGQRAKLNFPAQPPHHRPLPDQQSLRENSGSNAASPVHVALAPTTQQDIWEGLNEIMMMEEERSFWSMR

SEQ ID NO: 6022 - protein, 253 aa, Triticum aestivum
  misc_feature (1)..(253): useful for making plants with modified plant phenotypes as described in USSN 12/139,269
  misc_feature (1)..(253): Ceres CLONE ID no. 901326
  misc_feature (1)..(253): Utility: Useful for delaying flowering time
  misc_feature (1)..(253): Utility: Useful for increasing chlorophyll and photosynthetic capacity
  misc_feature (1)..(253): Utility: Useful for making larger plants
  misc_feature (1)..(253): Utility: Useful for making ornamental plants with modified flowers
  misc_feature (1)..(253): Utility: Useful for making ornamental plants with modified leaves
  misc_feature (1)..(253): Utility: Useful for making plants sterile and for genetic confinement
  misc_feature (1)..(253): Utility: Useful for making plants with altered leaf shape eg curled leaves
  misc_feature (1)..(253): Utility: Useful for making plants with enhanced plant architecture
  misc_feature (1)..(253): Utility: Useful for making plants with increased biomass
  misc_feature (1)..(253): Utility: Useful for making plants with increased biomass and foliage
  misc_feature (1)..(253): Utility: Useful for making smaller plants
  misc_feature (1)..(253): Utility: Useful for modifying plant structure, ie increased branching
MVPRLERGGGGGFQLPNSEQENSLFLRALISVVSGDTAAPALHPEPSNPPFAAAAAAPVPACGRCGADGCPGCEFAAAAAAATTGSSSEGEECSAASFVRNGGVGKRRAGGGGSKFRGVRQRPWGKWAAEIRDPHRAVRKWLGTFDTAAEAARAYDVAALEFRGHRAKLNFPASSSAASASASASASSWAAAQPHPQRQQRPESPREKCGSNASSPAHVPEQGRPVAREQEIWDGLHEIMMMDDGSFWSNPKP

SEQ ID NO: 6023 - protein, 230 aa, Zea mays
  misc_feature (1)..(230): useful for making plants with modified plant phenotypes as described in USSN 12/139,269
  misc_feature (1)..(230): Ceres CLONE ID no. 1446523
  misc_feature (1)..(230): Utility: Useful for delaying flowering time
  misc_feature (1)..(230): Utility: Useful for increasing chlorophyll and photosynthetic capacity
  misc_feature (1)..(230): Utility: Useful for making larger plants
  misc_feature (1)..(230): Utility: Useful for making ornamental plants with modified flowers
  misc_feature (1)..(230): Utility: Useful for making ornamental plants with modified leaves
  misc_feature (1)..(230): Utility: Useful for making plants sterile and for genetic confinement
  misc_feature (1)..(230): Utility: Useful for making plants with altered leaf shape eg curled leaves
  misc_feature (1)..(230): Utility: Useful for making plants with enhanced plant architecture
  misc_feature (1)..(230): Utility: Useful for making plants with increased biomass
  misc_feature (1)..(230): Utility: Useful for making plants with increased biomass and foliage
  misc_feature (1)..(230): Utility: Useful for making smaller plants
  misc_feature (1)..(230): Utility: Useful for modifying plant structure, ie increased branching
MTSRLESGGFQLPNTEQENALLLRALISVVSGDTASASLVPEAAAAEAPAAAASACGCPGGCELAAASSSDSDGAECSASGGGAGKRRRRRSRASSYMGVRRRPWGKWAAEIRDPRRAARKWLGTFDTAEDAARAYDAAAVELRGRRAKLNFPDAAAAAAARDVQPRRPLPGQSLRENCGSNAASPLHVAVARAPTTLQGTGPAPPKDQDIWDGLNEIMTMDDGSFWSMP

SEQ ID NO: 6024 - protein, 236 aa, Zea mays
  misc_feature (1)..(236): useful for making plants with modified plant phenotypes as described in USSN 12/139,269
  misc_feature (1)..(236): Ceres CLONE ID no. 461977
  misc_feature (1)..(236): Utility: Useful for delaying flowering time
  misc_feature (1)..(236): Utility: Useful for increasing chlorophyll and photosynthetic capacity
  misc_feature (1)..(236): Utility: Useful for making larger plants
  misc_feature (1)..(236): Utility: Useful for making ornamental plants with modified flowers
  misc_feature (1)..(236): Utility: Useful for making ornamental plants with modified leaves
  misc_feature (1)..(236): Utility: Useful for making plants sterile and for genetic confinement
  misc_feature (1)..(236): Utility: Useful for making plants with altered leaf shape eg curled leaves
  misc_feature (1)..(236): Utility: Useful for making plants with enhanced plant architecture
  misc_feature (1)..(236): Utility: Useful for making plants with increased biomass
  misc_feature (1)..(236): Utility: Useful for making plants with increased biomass and foliage
  misc_feature (1)..(236): Utility: Useful for making smaller plants
  misc_feature (1)..(236): Utility: Useful for modifying plant structure, ie increased branching
MAAPRLERGGFQLPNTEQENSLFLRALISVVSGDTAALLPEAAAVEAPAAPVACARCGADGCAAAGCCELVAGSSSDSDDAGCSGTRANGGGLGLGLGASKRRGRGRKVIQYRGVRRRPWGKWAAEIRDPRRAARKWLGTFDTAEDAARAYDVAAVELRGQRAKLNFPARAAAAAPAAVQPPHHRPLPDRSLRENCGSNAASPVHVALAPTTQQNIWEGLNEIMMMEEERSFWSMR

SEQ ID NO: 6025 - protein, 242 aa, Zea mays
  misc_feature (1)..(242): useful for making plants with modified plant phenotypes as described in USSN 12/139,269
  misc_feature (1)..(242): Public GI no. 50913081
  misc_feature (1)..(242): Utility: Useful for delaying flowering time
  misc_feature (1)..(242): Utility: Useful for increasing chlorophyll and photosynthetic capacity
  misc_feature (1)..(242): Utility: Useful for making larger plants
  misc_feature (1)..(242): Utility: Useful for making ornamental plants with modified flowers
  misc_feature (1)..(242): Utility: Useful for making ornamental plants with modified leaves
  misc_feature (1)..(242): Utility: Useful for making plants sterile and for genetic confinement
  misc_feature (1)..(242): Utility: Useful for making plants with altered leaf shape eg curled leaves
  misc_feature (1)..(242): Utility: Useful for making plants with enhanced plant architecture
  misc_feature (1)..(242): Utility: Useful for making plants with increased biomass
  misc_feature (1)..(242): Utility: Useful for making plants with increased biomass and foliage
  misc_feature (1)..(242): Utility: Useful for making smaller plants
  misc_feature (1)..(242): Utility: Useful for modifying plant structure, ie increased branching
MVPRVERGGGGFHLPNSEREDSLFIRALISVVSGDTTVPTLLPEPTMATVVAGAATCARCGVDGCIGVDCEVVVLAAAAGSSCSDEEDEGECTTGAVASGGVTGGVGKRRPRRRSGGEGSRYRGVRRRPWGKWAAEIRDPRRAVCKWLGTFDTAEDAARAYDVAALEFRGQRAKLNFPASTAAQQPRPLLHHNLRENCGSNASSPVHAPEHARTAAAAKDQEIWDGLREIMMLDDGSFWSMP

SEQ ID NO: 6026 - DNA, 1499 bp, Arabidopsis thaliana
  misc_feature (1)..(1499): useful for making plants with modified plant phenotypes as described in USSN 12/139,269
  misc_feature (1)..(1499): Ceres CLONE ID no. 141805
  misc_feature (1)..(1499): Also known as  Ceres CDNA ID no. 23375958
atctcttgttctctccgcccatctctgctctcttttattttcccagaaagtttttttttttttcccgaattccgttaatctcattggggtttccattgatagcaatggcgacggctttcgctcccactaagctcactgccacggttcctctgcatggatcccatgagaatcgtctcttgctcccgatccgattggctcctccttcttctttcctcggatccacccgttccctctcccttcgcagactcaatcactccaacgccacccgtcgatctcccgtcgtctctgtccaggaagttgtcaaggagaagcaatccaccaataataccagcctgttgataaccaaagaggaaggattggagttgtatgaagatatgatactaggtagatctttcgaagacatgtgtgctcaaatgtattaccgaggcaagatgtttggttttgttcacttgtacaatggccaagaggctgtttctactggctttatcaagctccttaccaagtctgactctgtcgttagtacctaccgtgaccatgtccatgccctcagcaaaggtgtctctgctcgtgctgttatgagcgagctcttcggcaaggttactggatgctgcagaggccaaggtggatccatgcacatgttctccaaagaacacaacatgcttggtggctttgcttttattggtgaaggcattcctgtcgccactggtgctgcctttagctccaagtacaggagggaagtcttgaaacaggattgtgatgatgtcactgtcgcctttttcggagatggaacttgtaacaacggacagttcttcgagtgtctcaacatggctgctctctataaactgcctattatctttgttgtcgagaataacttgtgggccattgggatgtctcacttgagagccacttctgaccccgagatttggaagaaaggtcctgcatttgggatgcctggtgttcatgttgacggtatggatgtcttgaaggtcagggaagtcgctaaagaggctgtcactagagctagaagaggagaaggtccaaccttggttgaatgtgagacttatagatttagaggacactccttggctgatcccgatgagctccgtgatgctgctgagaaagccaaatacgcggctagagacccaatcgcagcattgaagaagtatttgatagagaacaagcttgcaaaggaagcagagctaaagtcaatagagaaaaagatagacgagttggtggaggaagcggttgagtttgcagacgctagtccacagcccggtcgcagtcagttgctagagaatgtgtttgctgatccaaaaggatttggaattggacctgatggacggtacagatgtgaggaccccaagtttaccgaaggcacagctcaagtctgagaagacaagtttaaccataagctgtctactgtctcttcgatgtttctatatatcttattaagttaaatgctacagagaatcagtttgaatcatttgcactttttgctg

SEQ ID NO: 6027 - protein, 428 aa, Arabidopsis thaliana
  misc_feature (1)..(428): useful for making plants with modified plant phenotypes as described in USSN 12/139,269
  misc_feature (89)..(393): Pfam Name: E1_dh; Pfam Description: Dehydrogenase E1 component
  misc_feature (165)..(317): Pfam Name: TPP_enzyme_C; Pfam Description: Thiamine pyrophosphate enzyme, C-terminal TPP binding domain
  misc_feature (1)..(428): Utility: Useful for delaying flowering time
MATAFAPTKLTATVPLHGSHENRLLLPIRLAPPSSFLGSTRSLSLRRLNHSNATRRSPVVSVQEVVKEKQSTNNTSLLITKEEGLELYEDMILGRSFEDMCAQMYYRGKMFGFVHLYNGQEAVSTGFIKLLTKSDSVVSTYRDHVHALSKGVSARAVMSELFGKVTGCCRGQGGSMHMFSKEHNMLGGFAFIGEGIPVATGAAFSSKYRREVLKQDCDDVTVAFFGDGTCNNGQFFECLNMAALYKLPIIFVVENNLWAIGMSHLRATSDPEIWKKGPAFGMPGVHVDGMDVLKVREVAKEAVTRARRGEGPTLVECETYRFRGHSLADPDELRDAAEKAKYAARDPIAALKKYLIENKLAKEAELKSIEKKIDELVEEAVEFADASPQPGRSQLLENVFADPKGFGIGPDGRYRCEDPKFTEGTAQV

SEQ ID NO: 6028 - protein, 425 aa, Arabidopsis thaliana
  misc_feature (1)..(425): useful for making plants with modified plant phenotypes as described in USSN 12/139,269
  misc_feature (1)..(425): Public GI no. 50921411
  misc_feature (1)..(425): Utility: Useful for delaying flowering time
MAAASSFTAAAKFLAPVSARSAGDYKPPLPLPASASLRPGRKPAPRLRTALAVSSDVLPGNKAAPAAAAHSAVTREEALELYEDMVLGRIFEDMCAQMYYRGKMFGFVHLYNGQEAVSTGFIKLLNQADCVVSTYRDHVHALSKGVPARSVMAELFGKATGCCRGQGGSMHMFSEPHNLLGGFAFIGEGIPVATGAAFAAKYRHEVLKQSSPDGLDVTLAFFGDGTCNNGQFFECLNMAQLWKLPIVFVVENNLWAIGMSHLRATSDPEIYKKGPAFGMPGVHVDGMDVLKVREVAKEAIERARRGEGPTLVECETYRFRGHSLADPDELRRPDEKSHYAARDPITALKKYIIEQNLATESELKSIEKKIDDVVEEAVEFADASPLPPRSQLLENVFSDPKGFGIGPDGKYRCEDPLFTQGTAQV

SEQ ID NO: 6029 - protein, 420 aa, Triticum aestivum
  misc_feature (1)..(420): useful for making plants with modified plant phenotypes as described in USSN 12/139,269
  misc_feature (1)..(420): Ceres CLONE ID no. 616282
  misc_feature (1)..(420): Utility: Useful for delaying flowering time
  misc_feature (164)..(164): Xaa is any aa, unknown or other
  misc_feature (217)..(217): Xaa is any aa, unknown or other
  misc_feature (218)..(218): Xaa is any aa, unknown or other
  misc_feature (219)..(219): Xaa is any aa, unknown or other
MAAASFTAAKFLAPAAARSGGDRAPFPAPSAFSMRSLRHRPARRLSSVLAVSSDVLKAAPAAAAYPAVTREEALELYEDMILGRNFEDMCAQMYYRGKMFGFVHLYNGQEAVSTGFIKQLNQPDCVVSTYRDHVHALSKGVPARAVMAELFGKATGCCRGQGGXMHMFSEPHNLLGGFAFIGEGIPVATGAAFAAKYRHEVLKQSSPDGLDVTLAFXXXGTCNNGQFFECLNMAQLWKLPIIFVVENNLWAIGMSHLRSTSDPEIWKKGPAFGMPGVHVDGMDVLKVREVAKEAIDRARRGEGPTLVECETYRFRGHSLADPDELRRPDEKSHYAARDPITSLKKYIIEQNLASEAELKNIEKKIDDVVEEAVEFADASPLPPRSQLLENVFADPKGFGIGPDGKYRCEDPKFTQGTAQV

SEQ ID NO: 6030 - protein, 432 aa, Glycine max
  misc_feature (1)..(432): useful for making plants with modified plant phenotypes as described in USSN 12/139,269
  misc_feature (1)..(432): Ceres CLONE ID no. 524063
  misc_feature (1)..(432): Utility: Useful for delaying flowering time
MSFTATKFSPSPLPLTSTTPRSNDKPLSFSFDHSKPNPSSSFLGSTRKLLRFNALARPHAHPRASSSPAAAVLLERTSNLLVTKEEGLELYEDMILGRFFEDKCAEMYYRGKMFGFVHLYNGQEAVSTGFIKLLKKEDSVVSTYRDHVHALSKGVPSRQVMSELFGKATGCCRGQGGSMHMFSKEHNLLGGFAFIGEGIPVATGAAFSSKYRREVLKQADCDHVTLAFFGDGTCNNGQFYECLNMAALWKLPIVFVVENNLWAIGMSHLRATSDPQIWKKGPAFGMPGVHVDGMDVLKVREVAKEAVERARRGDGPTLVECETYRFRGHSLADPDELRDPAEKEHYAGRDPITALKQYLIENNLANEQELKAIEKKIDEILEDAVEFADSSPLPPRSQLLENVFADPKGFGIGPDGRYRCEDPKFTEGTAHV

SEQ ID NO: 6031 - protein, 427 aa, Glycine max
  misc_feature (1)..(427): useful for making plants with modified plant phenotypes as described in USSN 12/139,269
  misc_feature (1)..(427): Ceres CLONE ID no. 482085
  misc_feature (1)..(427): Utility: Useful for delaying flowering time
MSLSVPKLARPLPLHHHSSYGSLTMSFHTFTPFLGSTHKLRFISPIKLNAPRFNSSVVSVSDLFKNNKPKSTTNLLITKEEGLQLYEDMVLGRSFEDMCAQMYYRGKMFGFVHLYNGQEAVSTGFINFLKKEDCVVSTYRDHVHALSKGVPARAVMSELFGKATGCSRGQGGSMHMFSKEHNLIGGFAFIAEGIPVATGAAFSSKYRREVLKEADCDHVTLAFFGDGTCNNGQFYECLNMAALWKLPIVFVVENNLWAIGMSHLRATSDPQIWKKGPAFGMPGVHVDGMDVLKVREVAKEAIERARRGEGPTLVECETYRFRGHSLADPDELRDPAEKAHYAGRDPISALKKYMIENKLASEQELKTIDKKIEEVVEDAVEFADESPHPPRSQLLENVFADPKGFGIGPDGKYRCEDPKFTEGTAHV

SEQ ID NO: 6032 - DNA, 1355 bp, Arabidopsis thaliana
  misc_feature (1)..(1355): useful for making plants with modified plant phenotypes as described in USSN 12/139,269
  misc_feature (1)..(1355): Ceres CLONE ID no. 141890
  misc_feature (1)..(1355): Also known as  Ceres CDNA ID no. 23380862
ataacttataaacctttgttgcagaatctcatttaattctctctatgcaatcttttctttttgttctgtgaaggtctaaattcttgaaggattcaaaagtttccgatgaatacacgttattccaatcagccggagttatcttctagtaatatcacgatcactatttcatcgtctgctttgttaagctcctcaccgcgaggcgataacagtcatgttgctgctgctaatggtcaagagaggtctccatcttcgttttatataaggctggctatgaaggtatctagagctagatggttcatcttcttgagaagagtgtttcactaccagaacggttcaagatctgaccttgggtctaatcctttcaattctagcacttggatgatgtctgagctcattgctctacttgttcagctcactgtgataacattcactctagctatctccaaagaagagagaccaatttggccagtgaggctatggatcacaggatacgatgtgggatgtcttttgaatctcatgctgttatatggtcggtatcgtcaactagacattaaccaaggaaatgggtttgtccttggcgatgttgagcagcaacagagaggcagagaagaaactaggtcctctcacttgatgaacaaatgcagaacgtcgctagagcttttctttgcgatttggtttgtgattggaaatgtttgggtgttcgattctaggtttggttctttccaccatgctcccaagcttcacgttctctgcgtctctcttttagcttggaacgctatctgctattcctttccctttcttctcttcctcttcctctgttgccttgttcctctcataagtagcctccttggatataacatgaacatgggatcctcagacagagcagcatcagatgaccaaatctctagtctccctagctggaaattcaaacgaatcgacgatagtgcttctgattctgattcagattcagctactgtaactgatgatccagagtgttgtatatgtttggcaaagtataaagacaaagaagaagtaaggaagcttccatgttcacataagtttcactcaaagtgtgtagatcaatggcttcgtatcatctcttgttgtcctctctgcaaacaagatcttccaagatgacaaagcaaataccctaaaagcaacaaaagctcaatataatttttttctttcaaagtttttttttttttttagttttggattgaagcaaagtcgattacttgtgtgagtgtcaaattttttgtacataaagagctcaccagtaatcgttatgtacattgtgagtagatgatgcaaatcacaatggcaacaactttataaaatcttaatatagtgtttat

SEQ ID NO: 6033 - protein, 343 aa, Arabidopsis thaliana
  misc_feature (1)..(343): useful for making plants with modified plant phenotypes as described in USSN 12/139,269
  misc_feature (297)..(337): Pfam Name: zf-C3HC4; Pfam Description: Zinc finger, C3HC4 type (RING finger)
  misc_feature (1)..(343): Utility: Useful for delaying flowering time
  misc_feature (1)..(343): Utility: Useful for increasing chlorophyll and photosynthetic capacity
  misc_feature (1)..(343): Utility: Useful for making smaller plants
MNTRYSNQPELSSSNITITISSSALLSSSPRGDNSHVAAANGQERSPSSFYIRLAMKVSRARWFIFLRRVFHYQNGSRSDLGSNPFNSSTWMMSELIALLVQLTVITFTLAISKEERPIWPVRLWITGYDVGCLLNLMLLYGRYRQLDINQGNGFVLGDVEQQQRGREETRSSHLMNKCRTSLELFFAIWFVIGNVWVFDSRFGSFHHAPKLHVLCVSLLAWNAICYSFPFLLFLFLCCLVPLISSLLGYNMNMGSSDRAASDDQISSLPSWKFKRIDDSASDSDSDSATVTDDPECCICLAKYKDKEEVRKLPCSHKFHSKCVDQWLRIISCCPLCKQDLPR

SEQ ID NO: 6034 - protein, 304 aa, Arabidopsis thaliana
  misc_feature (1)..(304): useful for making plants with modified plant phenotypes as described in USSN 12/139,269
  misc_feature (1)..(304): Public GI no. 34911538
  misc_feature (1)..(304): Utility: Useful for delaying flowering time
  misc_feature (1)..(304): Utility: Useful for increasing chlorophyll and photosynthetic capacity
  misc_feature (1)..(304): Utility: Useful for making smaller plants
MRPPSSSATPGTGRVSAFTMRAVARMSRARWFIFLRRVYQYQNGPRSDLGSNPFNSPGWLALELGVIMAQMVVTTAVVATSPKERPAWPLRVWVAAYNVGNVLSLPLLYWRHRHSSSGARGGTLSDDPEMHGANDPLRNRSYLMNKARAFLELFFAMWFVMGNVWVFDARLGSFHRAPRLYALCIGLLAWNAVVYSLPFLLFLLLCCFVPAVGYALGYNMNSASVGRGASDEQLAALPQWRFKEPADAPRDRDHDDQECCICLAQYKEKEEVRQLPCTHMFHLKCVDRWLRIISSCPLCKQELS

SEQ ID NO: 6035 - DNA, 648 bp, Arabidopsis thaliana
  misc_feature (1)..(648): useful for making plants with modified plant phenotypes as described in USSN 12/139,269
  misc_feature (1)..(648): Ceres CLONE ID no. 147358
  misc_feature (1)..(648): Also known as  Ceres CDNA ID no. 0
aaaaaacaaaaagcgtcactaggaagctgcgactatttgactgactctaatttcacgcaactccttgtgagattctccgattgcttcgcctgagtttctgggttaactctccacgccgtcactttgatctttgcttttccgatctttagggtttttgtttagggatttatcgaagactctgctctatcatgtctggaagaaaagaaacggttttagatttggccaagtttgtagataagggtgtgcaagttaagctcactggtggtagacaagtgactggaactcttaaaggctatgaccaattgcttaatcttgttcttgatgaagcagtcgagtttgttcgagatcatgatgatcctttgaagactacggatcagacaagacgccttggtttgattgtttgccgtggaacagcggtgatgcttgtctcaccaaccgatggcaccgaagaaatcgctaacccgttcgttacagcagaggctgtctaaaagactttcttctcaaacaatatgtctctctattagtttaacttggcgatttagagagtattttatctaactctctggtgtgatgttggaaacatatatgttcaatttaaactatttggaacatcatggacacttcttcttgttacctaacttcgttccc

SEQ ID NO: 6036 - protein, 99 aa, Arabidopsis thaliana
  misc_feature (1)..(99): useful for making plants with modified plant phenotypes as described in USSN 12/139,269
  misc_feature (9)..(82): Pfam Name: LSM; Pfam Description: LSM domain
  misc_feature (1)..(99): Utility: Useful for delaying flowering time
  misc_feature (1)..(99): Utility: Useful for increasing chlorophyll and photosynthetic capacity
  misc_feature (1)..(99): Utility: Useful for making lethal plants for genetic confinement systems
  misc_feature (1)..(99): Utility: Useful for making ornamental plants with modified leaves
  misc_feature (1)..(99): Utility: Useful for making plants with altered leaf shape eg curled leaves
  misc_feature (1)..(99): Utility: Useful for making plants with increased biomass and foliage
  misc_feature (1)..(99): Utility: Useful for making smaller plants
  misc_feature (1)..(99): Utility: Useful for making stronger plants
MSGRKETVLDLAKFVDKGVQVKLTGGRQVTGTLKGYDQLLNLVLDEAVEFVRDHDDPLKTTDQTRRLGLIVCRGTAVMLVSPTDGTEEIANPFVTAEAV

SEQ ID NO: 6037 - protein, 99 aa, Brassica napus; identical to SEQ ID NO: 5916
  misc_feature (1)..(99): useful for making plants with modified plant phenotypes as described in USSN 12/139,269
  misc_feature (1)..(99): Ceres CLONE ID no. 1064362
  misc_feature (1)..(99): Utility: Useful for delaying flowering time
  misc_feature (1)..(99): Utility: Useful for increasing chlorophyll and photosynthetic capacity
  misc_feature (1)..(99): Utility: Useful for making lethal plants for genetic confinement systems
  misc_feature (1)..(99): Utility: Useful for making ornamental plants with modified leaves
  misc_feature (1)..(99): Utility: Useful for making plants with altered leaf shape eg curled leaves
  misc_feature (1)..(99): Utility: Useful for making plants with increased biomass and foliage
  misc_feature (1)..(99): Utility: Useful for making smaller plants
  misc_feature (1)..(99): Utility: Useful for making stronger plants

SEQ ID NO: 6038 - protein, 99 aa, Brassica napus; identical to SEQ ID NO: 5915
  misc_feature (1)..(99): useful for making plants with modified plant phenotypes as described in USSN 12/139,269
  misc_feature (1)..(99): Ceres CLONE ID no. 1073419
  misc_feature (1)..(99): Utility: Useful for delaying flowering time
  misc_feature (1)..(99): Utility: Useful for increasing chlorophyll and photosynthetic capacity
  misc_feature (1)..(99): Utility: Useful for making lethal plants for genetic confinement systems
  misc_feature (1)..(99): Utility: Useful for making ornamental plants with modified leaves
  misc_feature (1)..(99): Utility: Useful for making plants with altered leaf shape eg curled leaves
  misc_feature (1)..(99): Utility: Useful for making plants with increased biomass and foliage
  misc_feature (1)..(99): Utility: Useful for making smaller plants
  misc_feature (1)..(99): Utility: Useful for making stronger plants

SEQ ID NO: 6039 - protein, 98 aa, Brassica napus; identical to SEQ ID NO: 5918
  misc_feature (1)..(98): useful for making plants with modified plant phenotypes as described in USSN 12/139,269
  misc_feature (1)..(98): Public GI no. 50941651
  misc_feature (1)..(98): Utility: Useful for delaying flowering time
  misc_feature (1)..(98): Utility: Useful for increasing chlorophyll and photosynthetic capacity
  misc_feature (1)..(98): Utility: Useful for making lethal plants for genetic confinement systems
  misc_feature (1)..(98): Utility: Useful for making ornamental plants with modified leaves
  misc_feature (1)..(98): Utility: Useful for making plants with altered leaf shape eg curled leaves
  misc_feature (1)..(98): Utility: Useful for making plants with increased biomass and foliage
  misc_feature (1)..(98): Utility: Useful for making smaller plants
  misc_feature (1)..(98): Utility: Useful for making stronger plants

SEQ ID NO: 6040 - protein, 156 aa, Zea mays
  misc_feature (1)..(156): useful for making plants with modified plant phenotypes as described in USSN 12/139,269
  misc_feature (1)..(156): Ceres CLONE ID no. 226155
  misc_feature (1)..(156): Utility: Useful for delaying flowering time
  misc_feature (1)..(156): Utility: Useful for increasing chlorophyll and photosynthetic capacity
  misc_feature (1)..(156): Utility: Useful for making lethal plants for genetic confinement systems
  misc_feature (1)..(156): Utility: Useful for making ornamental plants with modified leaves
  misc_feature (1)..(156): Utility: Useful for making plants with altered leaf shape eg curled leaves
  misc_feature (1)..(156): Utility: Useful for making plants with increased biomass and foliage
  misc_feature (1)..(156): Utility: Useful for making smaller plants
  misc_feature (1)..(156): Utility: Useful for making stronger plants
MYGQGPALFLGEFFPLPPLRPCRAAAAASTVRAKIRSSLSAIFGRRRQQDLREGFRVEMAGRKETALDLAKFVDKGVQVKLTGGRQVTGTLKGYDQLLNLVLDEAVENEREQDDPLKLSGKTRQLGLIVCRGTAVMLVSPTDGTDEIANPFLADGA

SEQ ID NO: 6041 - protein, 98 aa, Zea mays
  misc_feature (1)..(98): useful for making plants with modified plant phenotypes as described in USSN 12/139,269
  misc_feature (1)..(98): Ceres CLONE ID no. 1452131
  misc_feature (1)..(98): Utility: Useful for delaying flowering time
  misc_feature (1)..(98): Utility: Useful for increasing chlorophyll and photosynthetic capacity
  misc_feature (1)..(98): Utility: Useful for making lethal plants for genetic confinement systems
  misc_feature (1)..(98): Utility: Useful for making ornamental plants with modified leaves
  misc_feature (1)..(98): Utility: Useful for making plants with altered leaf shape eg curled leaves
  misc_feature (1)..(98): Utility: Useful for making plants with increased biomass and foliage
  misc_feature (1)..(98): Utility: Useful for making smaller plants
  misc_feature (1)..(98): Utility: Useful for making stronger plants
MAGRKETALDLAKFVDKGVQVKLTGGRQVTGTLKGYDQLLNLVLDEAVENEREQDDPLKLSGKTRQLGLIVCRGTAVMLVSPTDGTDEIANPFLADGA

SEQ ID NO: 6042 - protein, 100 aa, Triticum aestivum; identical to SEQ ID NO: 5922
  misc_feature (1)..(100): useful for making plants with modified plant phenotypes as described in USSN 12/139,269
  misc_feature (1)..(100): Ceres CLONE ID no. 606064
  misc_feature (1)..(100): Utility: Useful for delaying flowering time
  misc_feature (1)..(100): Utility: Useful for increasing chlorophyll and photosynthetic capacity
  misc_feature (1)..(100): Utility: Useful for making lethal plants for genetic confinement systems
  misc_feature (1)..(100): Utility: Useful for making ornamental plants with modified leaves
  misc_feature (1)..(100): Utility: Useful for making plants with altered leaf shape eg curled leaves
  misc_feature (1)..(100): Utility: Useful for making plants with increased biomass and foliage
  misc_feature (1)..(100): Utility: Useful for making smaller plants
  misc_feature (1)..(100): Utility: Useful for making stronger plants

SEQ ID NO: 6043 - protein, 100 aa, Zea mays; identical to SEQ ID NO: 5922
  misc_feature (1)..(100): useful for making plants with modified plant phenotypes as described in USSN 12/139,269
  misc_feature (1)..(100): Ceres CLONE ID no. 1502051
  misc_feature (1)..(100): Utility: Useful for delaying flowering time
  misc_feature (1)..(100): Utility: Useful for increasing chlorophyll and photosynthetic capacity
  misc_feature (1)..(100): Utility: Useful for making lethal plants for genetic confinement systems
  misc_feature (1)..(100): Utility: Useful for making ornamental plants with modified leaves
  misc_feature (1)..(100): Utility: Useful for making plants with altered leaf shape eg curled leaves
  misc_feature (1)..(100): Utility: Useful for making plants with increased biomass and foliage
  misc_feature (1)..(100): Utility: Useful for making smaller plants
  misc_feature (1)..(100): Utility: Useful for making stronger plants

SEQ ID NO: 6044 - protein, 100 aa, Triticum aestivum; identical to SEQ ID NO: 5922
  misc_feature (1)..(100): useful for making plants with modified plant phenotypes as described in USSN 12/139,269
  misc_feature (1)..(100): Ceres CLONE ID no. 1018838
  misc_feature (1)..(100): Utility: Useful for delaying flowering time
  misc_feature (1)..(100): Utility: Useful for increasing chlorophyll and photosynthetic capacity
  misc_feature (1)..(100): Utility: Useful for making lethal plants for genetic confinement systems
  misc_feature (1)..(100): Utility: Useful for making ornamental plants with modified leaves
  misc_feature (1)..(100): Utility: Useful for making plants with altered leaf shape eg curled leaves
  misc_feature (1)..(100): Utility: Useful for making plants with increased biomass and foliage
  misc_feature (1)..(100): Utility: Useful for making smaller plants
  misc_feature (1)..(100): Utility: Useful for making stronger plants

SEQ ID NO: 6045 - protein, 104 aa, Triticum aestivum; identical to SEQ ID NO: 5919
  misc_feature (1)..(104): useful for making plants with modified plant phenotypes as described in USSN 12/139,269
  misc_feature (1)..(104): Ceres CLONE ID no. 685838
  misc_feature (1)..(104): Utility: Useful for delaying flowering time
  misc_feature (1)..(104): Utility: Useful for increasing chlorophyll and photosynthetic capacity
  misc_feature (1)..(104): Utility: Useful for making lethal plants for genetic confinement systems
  misc_feature (1)..(104): Utility: Useful for making ornamental plants with modified leaves
  misc_feature (1)..(104): Utility: Useful for making plants with altered leaf shape eg curled leaves
  misc_feature (1)..(104): Utility: Useful for making plants with increased biomass and foliage
  misc_feature (1)..(104): Utility: Useful for making smaller plants
  misc_feature (1)..(104): Utility: Useful for making stronger plants

SEQ ID NO: 6046 - protein, 98 aa, Zea mays; identical to SEQ ID NO: 5920
  misc_feature (1)..(98): useful for making plants with modified plant phenotypes as described in USSN 12/139,269
  misc_feature (1)..(98): Ceres CLONE ID no. 462970
  misc_feature (1)..(98): Utility: Useful for delaying flowering time
  misc_feature (1)..(98): Utility: Useful for increasing chlorophyll and photosynthetic capacity
  misc_feature (1)..(98): Utility: Useful for making lethal plants for genetic confinement systems
  misc_feature (1)..(98): Utility: Useful for making ornamental plants with modified leaves
  misc_feature (1)..(98): Utility: Useful for making plants with altered leaf shape eg curled leaves
  misc_feature (1)..(98): Utility: Useful for making plants with increased biomass and foliage
  misc_feature (1)..(98): Utility: Useful for making smaller plants
  misc_feature (1)..(98): Utility: Useful for making stronger plants

SEQ ID NO: 6047 - protein, 98 aa, Zea mays; identical to SEQ ID NO: 5920
  misc_feature (1)..(98): useful for making plants with modified plant phenotypes as described in USSN 12/139,269
  misc_feature (1)..(98): Ceres CLONE ID no. 393073
  misc_feature (1)..(98): Utility: Useful for delaying flowering time
  misc_feature (1)..(98): Utility: Useful for increasing chlorophyll and photosynthetic capacity
  misc_feature (1)..(98): Utility: Useful for making lethal plants for genetic confinement systems
  misc_feature (1)..(98): Utility: Useful for making ornamental plants with modified leaves
  misc_feature (1)..(98): Utility: Useful for making plants with altered leaf shape eg curled leaves
  misc_feature (1)..(98): Utility: Useful for making plants with increased biomass and foliage
  misc_feature (1)..(98): Utility: Useful for making smaller plants
  misc_feature (1)..(98): Utility: Useful for making stronger plants

SEQ ID NO: 6048 - DNA, 1279 bp, Arabidopsis thaliana
  misc_feature (1)..(1279): useful for making plants with modified plant phenotypes as described in USSN 12/139,269
  misc_feature (1)..(1279): Ceres CLONE ID no. 148943
  misc_feature (1)..(1279): Also known as  Ceres CDNA ID no. 23365865
atccacacactgagaaacagcagaagaaaggcttgagagccttcttctccactattttcaatggctttaacattgtcaaccacaaagaccttcactaacataaactgctcaaacaatacttccaacataaccacctttaagcctctcaagcttcctcttttctggccatggcaaaaggtcaaaatgggtcctttaagtgtttctcctatgggttttgggacatgggcttggggtaatcagcttctttggggttatcagacttccatggatgatcagcttcaacaagcttttgaattggctttggaaaatggaatcaatttgtttgatactgctgattcttatggcactggtaggcttaatggccaaagtgagagacttttggggaaattcattaaagaatctcaaggacttaaagggaaacaaaatgaagtagtggtagctacaaagtttgcagcttatccatggaggttaacttcaggacagtttgtgaatgcctgcagagcttctttagaccggcttcagatagaccagctcgggattggacagcttcactggtcaactgcaaactacgcgcctctacaagagcttgttctttgggatggtctagtgcaaatgtacgaaaagggtttagttagagccgttggagttagtaactatggacctcaacagcttgtgaagattcatgattaccttaaaactcgaggggttcctttatgttctgcccaagtgcaattctcattgctaagcatgggaaaagagcaactagagatcaagagtatatgcgacgagctcgggattcgtttaatctcttatagtcctcttgggctaggaatgctaactgggaaatactcctcttcaaaacttcccactggtccacgatcattgctgttccgacaaattcttcctggattagaacctcttcttttagcactgagcgagattgcaaagaaacgaggaaagactatgcctcaggttgcaataaactggtgcatatgcaaagggacagtaccgataccgggaatcaagtcggtaagacatgtttaagataatttgggtgctctgggatggaaacttacaaatgatgaacagcttcagttagaatatgcagctaaagaatcaccaaagtcaatgattcagaatatttttcagacaagatgataggataagagaagatgcttatacacatctagaccacaaatgagaacaatgtgtataagtagaagttttaatctacttctttatatatgcacatattgtgaagaacacagatagttttctt

SEQ ID NO: 6049 - protein, 286 aa, Arabidopsis thaliana
  misc_feature (1)..(286): useful for making plants with modified plant phenotypes as described in USSN 12/139,269
  misc_feature (2)..(279): Pfam Name: Aldo_ket_red; Pfam Description: Aldo/keto reductase family
  misc_feature (2)..(279): Pfam Name: Aldo_ket_red; Pfam Description: Aldo/keto reductase family
  misc_feature (1)..(286): Utility: Useful for delaying flowering time
  misc_feature (1)..(286): Utility: Useful for making ornamental plants with modified leaves
  misc_feature (1)..(286): Utility: Useful for making plants with altered leaf shape eg curled leaves
  misc_feature (1)..(286): Utility: Useful for making plants with increased biomass and foliage
  misc_feature (1)..(286): Utility: Useful for making smaller plants
MGPLSVSPMGFGTWAWGNQLLWGYQTSMDDQLQQAFELALENGINLFDTADSYGTGRLNGQSERLLGKFIKESQGLKGKQNEVVVATKFAAYPWRLTSGQFVNACRASLDRLQIDQLGIGQLHWSTANYAPLQELVLWDGLVQMYEKGLVRAVGVSNYGPQQLVKIHDYLKTRGVPLCSAQVQFSLLSMGKEQLEIKSICDELGIRLISYSPLGLGMLTGKYSSSKLPTGPRSLLFRQILPGLEPLLLALSEIAKKRGKTMPQVAINWCICKGTVPIPGIKSVRHV

SEQ ID NO: 6050 - protein, 371 aa, Zea mays
  misc_feature (1)..(371): useful for making plants with modified plant phenotypes as described in USSN 12/139,269
  misc_feature (1)..(371): Ceres CLONE ID no. 294527
  misc_feature (1)..(371): Utility: Useful for delaying flowering time
  misc_feature (1)..(371): Utility: Useful for making ornamental plants with modified leaves
  misc_feature (1)..(371): Utility: Useful for making plants with altered leaf shape eg curled leaves
  misc_feature (1)..(371): Utility: Useful for making plants with increased biomass and foliage
  misc_feature (1)..(371): Utility: Useful for making smaller plants
MALPPGAGAVAPATPFAANPCRLRRASGPPAAALRLGPLFWPWEKVKIGPLSVSPMGFGTWAWGNQLLWGYQESMDNELQDCFNLALRNGINLFDTADSYGTGRLNGQSERLLGKFILEFEGRIKSPDDVVIATKFAAYPWRLTSGQFVSACKSSLERLQLDRLGIGQLHWSTANYAPLQERALWDGLVEMYEKGLVSAVGVSNYGPKQLLKIHSYLASRGVPLSSAQVQFSLLSMGDDQMELKSVCDSLGIRIIAYSPLGLGMLTGKYGASNLPKGPRSVLFRQILPGLEPLLSCLRRIAEKKGKTMPQVAINWCMCKGTVPIPGVKTVRHVQENLGALGWRLSSAEISELESAAMAAPRKMIQNVFQTA

SEQ ID NO: 6051 - protein, 375 aa, Zea mays
  misc_feature (1)..(375): useful for making plants with modified plant phenotypes as described in USSN 12/139,269
  misc_feature (1)..(375): Public GI no. 37536088
  misc_feature (1)..(375): Utility: Useful for delaying flowering time
  misc_feature (1)..(375): Utility: Useful for making ornamental plants with modified leaves
  misc_feature (1)..(375): Utility: Useful for making plants with altered leaf shape eg curled leaves
  misc_feature (1)..(375): Utility: Useful for making plants with increased biomass and foliage
  misc_feature (1)..(375): Utility: Useful for making smaller plants
MALPVTTRAAPAMPFAPQPRTAGGGLLRRPSPPAAALRIAPPLFWPWQKVKVGPLSVSPMGFGTWAWGNQLLWGYQESMDTELQECFNLALKNGINLFDTADSYGTGRLNGQSERLLGKFIREYEGPMKSPDDVIIATKFAAYPWRLTSGQFVSACKSSLERLQLDRLGIGQLHWSTANYAPLQERALWDGLVEMYEKGLVRAVGVSNYGPKQLLKIHSHLSSRGVPLSSAQVQFSLLSMGDEQMELKTVCDSLGIRLIAYSPLGLGMLTGKYTTSNLPSGPRSVLFRQILPGLESLLTCLKRIAERKGKTMSQVAINWCICKGTIPIPGVKTVRHVEDNLGALGWRLSPAEVSELEAAAMESPKRMVQNIFQTA

SEQ ID NO: 6052 - protein, 376 aa, Zea mays
  misc_feature (1)..(376): useful for making plants with modified plant phenotypes as described in USSN 12/139,269
  misc_feature (1)..(376): Public GI no. 34899608
  misc_feature (1)..(376): Utility: Useful for delaying flowering time
  misc_feature (1)..(376): Utility: Useful for making ornamental plants with modified leaves
  misc_feature (1)..(376): Utility: Useful for making plants with altered leaf shape eg curled leaves
  misc_feature (1)..(376): Utility: Useful for making plants with increased biomass and foliage
  misc_feature (1)..(376): Utility: Useful for making smaller plants
MAGTLQVAGGCLAPLLPSRRAAAAVRPPRASGASASAAAAAAAVEEDGKVRLGGSDVAVTKLGIGAWSWGDTTYWNEFQWDDRKLKAAKGAFDASVDCGITFFDTAEVYGAGISGAINSESLLGRFIKERQQKEQVEVAIATKFAALPWRLGRGSVISALKDSLSRLGVSSVELYQLHWPGIWGNEGYLDGLGDAYEQGLVKAVGVSNYSEKRLRDAYERLKKRGVPLASNQVNYSLIYRNPEENGVKAACDELGITLIAYSPIAQGVLTGKYTPNNPPTGPRGRIYTPEFLTKLQPLINRIKEIGGSYEKTPTQVVLNWLICQGNVVPIPGAKNAEQAREFAGALGWSLTDQEVEELRSMAREIKPVIGFPVEKL

SEQ ID NO: 6053 - protein, 376 aa, Zea mays
  misc_feature (1)..(376): useful for making plants with modified plant phenotypes as described in USSN 12/139,269
  misc_feature (1)..(376): Public GI no. 50882170
  misc_feature (1)..(376): Utility: Useful for delaying flowering time
  misc_feature (1)..(376): Utility: Useful for making ornamental plants with modified leaves
  misc_feature (1)..(376): Utility: Useful for making plants with altered leaf shape eg curled leaves
  misc_feature (1)..(376): Utility: Useful for making plants with increased biomass and foliage
  misc_feature (1)..(376): Utility: Useful for making smaller plants
MAAAMALQVVAGGGCCCQRPVLGAGRRRLAAARAVASDAAAAKVSEEEGKVRLGGSEVAVSKLGIGAWSWGDTTYWNDSEWDDRRLQEAKAAFDTSIDNGMTLFDTAEVYGTALMGAVNSESLLGGFIKERQEKEQIDVAVATKFAALPWRFGRGSVLSALKKSLDRLGLSSVELYQLHWPGLWGNEGYLDGLADAYEQGLVKAVGVSNYNEKRLRDAYARMKKRGVPLAANQVNYSLIYRTPELNGVKAACDELGITLIAYSPIAQGVLSGKYTPEKPPTGPRANTYTPEFLTKLQPLMNRIKEIGESYGKNPTQVSLNWLTCQGNVVPIPGAKNAGQAQEFAGALGWSLTGDEVEELRSLAREIKGIKMPIEES

SEQ ID NO: 6054 - protein, 375 aa, Zea mays
  misc_feature (1)..(375): useful for making plants with modified plant phenotypes as described in USSN 12/139,269
  misc_feature (1)..(375): Ceres CLONE ID no. 338088
  misc_feature (1)..(375): Utility: Useful for delaying flowering time
  misc_feature (1)..(375): Utility: Useful for making ornamental plants with modified leaves
  misc_feature (1)..(375): Utility: Useful for making plants with altered leaf shape eg curled leaves
  misc_feature (1)..(375): Utility: Useful for making plants with increased biomass and foliage
  misc_feature (1)..(375): Utility: Useful for making smaller plants
MITALQVSGGGLPLLFARRRRRAFRPPQAVASDAAAAAEGTAREDGGKVALGGSGVSVTKLGVGAWSWGDTTYWNEFRWDDTKLKAAKGAFDASIDCGITFFDTAEVYGAGVSGAINSESLLGRFIKERQRKEQVDVAVATKFAALPWRFGRGSVICALKASLDRLGVSSVELYQLHWPGIWGNEDYLDGLGDAVEQGLVKAVGVSNYSEKRLRDAYERLRKRGVPLASNQVNYSLIYRNPEENGVKAACDELGVTLIAYSPIAQDALTGKYTPESPPKGPRGRIYTPEFLTKLQPLINRIKEIGGSYGRTSTQVVLNWLVCQGNVVPIPGAKNAEQAREFAGALGWSLAPDEVEELRSMARQVKPVIGFPVEKL

SEQ ID NO: 6055 - protein, 377 aa, Zea mays
  misc_feature (1)..(377): useful for making plants with modified plant phenotypes as described in USSN 12/139,269
  misc_feature (1)..(377): Public GI no. 24111265
  misc_feature (1)..(377): Utility: Useful for delaying flowering time
  misc_feature (1)..(377): Utility: Useful for making ornamental plants with modified leaves
  misc_feature (1)..(377): Utility: Useful for making plants with altered leaf shape eg curled leaves
  misc_feature (1)..(377): Utility: Useful for making plants with increased biomass and foliage
  misc_feature (1)..(377): Utility: Useful for making smaller plants
MAMATHFTFPFNYVVSEGSHGRRSFVRKLVRAVASGDSVAPAISEESKVKLGGSDLKVTKLGIGVWSWGDNSYWNDFQWDDRKLKAAKGAFDTSLDNGIDFFDTAEVYGSKFSLGAISSETLLGRFIRERKERYPGAEVSVATKFAALPWRFGRESVVTALKDSLSRLELSSVDLYQLHWPGLWGNEGYLDGLGDAVEQGLVKAVGVSNYSEKRLRDAYERLKKRGIPLASNQVNYSLIYRAPEQTGVKAACDELGVTLIAYSPIAQGALTGKYTPENPPSGPRGRIYTREFLTKLQPLLNRIKQIGENYSKTPTQIALNWLVAQGNVIPIPGAKNAEQAKEFAGAIGWSLTDNEVSELRSLASEIKPVVGFPVEYL

SEQ ID NO: 6056 - DNA, 461 bp, Arabidopsis thaliana
  misc_feature (1)..(461): useful for making plants with modified plant phenotypes as described in USSN 12/139,269
  misc_feature (1)..(461): Ceres CLONE ID no. 149402
  misc_feature (1)..(461): Also known as  Ceres CDNA ID no. 23361827
aacttgtagcgaatcaaacattcttgtttttcagtgagctcacttcttcttcttctctactttccacaagactttgacttcgaagagcagaaaatggaaggaagaggtaaagtcagcttgatcaacggtggagatggaactagaaaaggtggtagagaacacagtagccgtccgatcccgaagagagggcaagtcaaagttgggatcttgcttggttttgctaattcttttgcttccatctttggctcaacgagaaacttccatggatcctaaacttaatcttctatcttctcatttcccacagaaatattttcattcactttttagaattttctgtggtttattggagtgagataagattggtgatcttgtagtgtctagtttgttgagttcaatttcatttttgtacaaatcctatgtagtttctcttgttaaaatatatatattgtgatctttccttc

SEQ ID NO: 6057 - protein, 72 aa, Arabidopsis thaliana
  misc_feature (1)..(72): useful for making plants with modified plant phenotypes as described in USSN 12/139,269
  misc_feature (1)..(72): Utility: Useful for delaying flowering time
  misc_feature (1)..(72): Utility: Useful for making larger plants
  misc_feature (1)..(72): Utility: Useful for making ornamental plants with modified leaves
  misc_feature (1)..(72): Utility: Useful for making plants sterile and for genetic confinement
  misc_feature (1)..(72): Utility: Useful for making plants with altered leaf shape eg curled leaves
  misc_feature (1)..(72): Utility: Useful for making plants with increased biomass
  misc_feature (1)..(72): Utility: Useful for making plants with increased biomass and foliage
  misc_feature (1)..(72): Utility: Useful for making smaller plants
MELEKVVENTVAVRSRREGKSKLGSCLVLLILLLPSLAQRETSMDPKLNLLSSHFPQKYFHSLFRIFCGLLE

SEQ ID NO: 6058 - DNA, 1471 bp, Arabidopsis thaliana
  misc_feature (1)..(1471): useful for making plants with modified plant phenotypes as described in USSN 12/139,269
  misc_feature (1)..(1471): Ceres CLONE ID no. 157547
  misc_feature (1)..(1471): Also known as  Ceres CDNA ID no. 23384444
atctttggtttttcttcactgacaaaacccctaaaaatggccgactcattcgagctaattgtaacccgaaaagaacctgttctcgtctctccagcctccgaaactccaaaaggtctccattatctctcaaatctcgatcaaaacatcgccatcattgtcaaaacattctactacttcaaatcaaactcaagatccaacgaagaatcctatgaagtcatcaagaagtcactctccgaggtcctcgttcactactatcctgccgcagggagactcacgatcagtcctgaaggaaagatcgctgtggattgcaccggagaaggagttgtagtggtggaagctgaggccaattgtgggatagagaagataaagaaggctatatcggagattgatcaaccagagactcttgaaaagttggtttacgacgttcccggtgctcggaatattctcgagattcctccagtggttgttcaggtgacaaatttcaagtgtggagggttcgtgctaggactaggcatgaaccacaatatgttcgatggtatcgcagccatggagttcctcaactcttgggccgagacggctcgtggccttcctctctccgttccacctttcttggaccgcacacttctccgaccacgaaccccaccaaagatcgaattcccacacaacgagttcgaggacctcgaagacatctccggcaccggaaaactctactccgacgagaaactcgtctacaaatccttcctcttcggacccgaaaaactcgagaggcttaagatcatggcagagacgagatccacgacttttcaaaccctaaccgggtttctgtggagagctcgttgtcaagccttagggcttaaacctgatcaacggatcaagcttctctttgctgcagatggaaggtcgagattcgttccggaacttcctaaaggatattccggtaacgggattgtgttcacttattgcgttacaacggcaggtgaagtgactttaaaccctctttctcattcagtgtgtttggtcaaaagagccgttgaaatggtcaacgacggtttcatgaggtcagcgattgattactttgaggtgactcgagctaggccgagcctaacggcaacacttctgatcacgtcgtgggcaaaactgtcgtttcatactaaggatttcggttggggtgaaccggttgtatctggaccggtcggtttacctgagaaggaagtgattctgtttctgccatgtggtagtgacacgaattatcaatgtgctgcttggacttcctggctcggctatgaaagtgttccaagggattatggatatatgaatcattaaaattatttatggtttaatgtttgaatttaaattaactatgatttaaaaagcaaataatgatgatatatcaattacgtgtttgtggtcgtatgaaatattgttcgtcggtggagcaaaaatgtaactaagatgttaaagtatcaagttt

SEQ ID NO: 6059 - protein, 269 aa, Arabidopsis thaliana
  misc_feature (1)..(269): useful for making plants with modified plant phenotypes as described in USSN 12/139,269
  misc_feature (1)..(227): Pfam Name: Transferase; Pfam Description: Transferase family
  misc_feature (1)..(269): Utility: Useful for delaying flowering time
  misc_feature (1)..(269): Utility: Useful for making ornamental plants with modified flowers
  misc_feature (1)..(269): Utility: Useful for making ornamental plants with modified leaves
  misc_feature (1)..(269): Utility: Useful for making plants sterile and for genetic confinement
  misc_feature (1)..(269): Utility: Useful for making plants with increased biomass
  misc_feature (1)..(269): Utility: Useful for making plants with increased biomass and foliage
  misc_feature (1)..(269): Utility: Useful for making smaller plants
MNHNMFDGIAAMEFLNSWAETARGLPLSVPPFLDRTLLRPRTPPKIEFPHNEFEDLEDISGTGKLYSDEKLVYKSFLFGPEKLERLKIMAETRSTTFQTLTGFLWRARCQALGLKPDQRIKLLFAADGRSRFVPELPKGYSGNGIVFTYCVTTAGEVTLNPLSHSVCLVKRAVEMVNDGFMRSAIDYFEVTRARPSLTATLLITSWAKLSFHTKDFGWGEPVVSGPVGLPEKEVILFLPCGSDTNYQCAAWTSWLGYESVPRDYGYMNH

SEQ ID NO: 6060 - protein, 431 aa, Glycine max
  misc_feature (1)..(431): useful for making plants with modified plant phenotypes as described in USSN 12/139,269
  misc_feature (1)..(431): Ceres CLONE ID no. 520302
  misc_feature (1)..(431): Utility: Useful for delaying flowering time
  misc_feature (1)..(431): Utility: Useful for making ornamental plants with modified flowers
  misc_feature (1)..(431): Utility: Useful for making ornamental plants with modified leaves
  misc_feature (1)..(431): Utility: Useful for making plants sterile and for genetic confinement
  misc_feature (1)..(431): Utility: Useful for making plants with increased biomass
  misc_feature (1)..(431): Utility: Useful for making plants with increased biomass and foliage
  misc_feature (1)..(431): Utility: Useful for making smaller plants
MSSIKLNVKQQGEPTRVLPAEETEKGLYFLSNLDQNIAVPVRTVYCFKSGSRGNEDAAQVIKESLSKILVPYYPMAGTLRISSEEKLIVDNPGEGAVFVEAEADFDIEEIGDLTKPDPDALGKLVYYVPGAPSILEMPLMTVQVTKFKCGGFTLGLCMIHCMKDGLCAMEFVNAWSQIARGLNLKTPPFLDRTIIKARDPPKIEFQHTEFAEIEDISNTKKLYEEENMLYRSVCFDTEKLDMLKKKATEDGVLEKCSTFEALSGFVWRARTAALGMQPDQQTKLLFAVDGRKRFVPPIPKGYFGNAIVLTNSLCNAGELLKNPLSFSVGLIREAIDMVTDSYMRSAIDYFEVTRARPSLTATLLITTWTKLSFHTADFGWGEPLCSGPVTLPEKEVILFLSHGQERKSVNVLLGLPSSAMVIFEALMMMQV

SEQ ID NO: 6061 - protein, 435 aa, Triticum aestivum
  misc_feature (1)..(435): useful for making plants with modified plant phenotypes as described in USSN 12/139,269
  misc_feature (1)..(435): Ceres CLONE ID no. 922101
  misc_feature (1)..(435): Utility: Useful for delaying flowering time
  misc_feature (1)..(435): Utility: Useful for making ornamental plants with modified flowers
  misc_feature (1)..(435): Utility: Useful for making ornamental plants with modified leaves
  misc_feature (1)..(435): Utility: Useful for making plants sterile and for genetic confinement
  misc_feature (1)..(435): Utility: Useful for making plants with increased biomass
  misc_feature (1)..(435): Utility: Useful for making plants with increased biomass and foliage
  misc_feature (1)..(435): Utility: Useful for making smaller plants
  misc_feature (180)..(180): Xaa is any aa, unknown or other
MAGSKVQLMSVKRGEPTLVSPAEATPTGEQYYLSNLDQNIAVIVQTVYCFKCPSGRGNEGAADALRAALARVLVHYHPLAGRLGISPEMKLIVECTGEGVPFVEAEAACDLALIGDLSTPDPAALGQLVYSVPGAKSILEMPPMTAQVTRFECGGFSIGLAMNHCMFDGLGAMEFVNSWXEMARGATELTVPPFLDRSVLRARDPPVISNPHHEFEEIADVSEMAALYGGQELVYRSFCFDPDRLERVRGLALADGDLERCTTFEALSGLVWRARTRALGLAPEQQTKLLFAVDGRRRFVPPLPKGYFGNGIVLTNALATAGDLLSAPVSRAAGKVQEAVRMVTDEYMRSAVDYFEATRSRPSLASTLLITTWSRLAFNGADFGWGEPTMSGPVTLPEKEVILFLAHGKERKSINVLLGLPASAMDTFQELMDEI

SEQ ID NO: 6062 - protein, 442 aa, Zea mays
  misc_feature (1)..(442): useful for making plants with modified plant phenotypes as described in USSN 12/139,269
  misc_feature (1)..(442): Ceres CLONE ID no. 265717
  misc_feature (1)..(442): Utility: Useful for delaying flowering time
  misc_feature (1)..(442): Utility: Useful for making ornamental plants with modified flowers
  misc_feature (1)..(442): Utility: Useful for making ornamental plants with modified leaves
  misc_feature (1)..(442): Utility: Useful for making plants sterile and for genetic confinement
  misc_feature (1)..(442): Utility: Useful for making plants with increased biomass
  misc_feature (1)..(442): Utility: Useful for making plants with increased biomass and foliage
  misc_feature (1)..(442): Utility: Useful for making smaller plants
MKENGGAVLAAGEKAPQVVVKRGEPTLVPPAEATPTGGQYYLSNLDQNIAVIVQTVYCYKPSGGGGDVAAALRDALARVLVHYYPLAGRLGVSPEMKLTVELTGEGAVFVEADAACELATVGDLTKPDPAALGQLVYSVPGAKHILEMPPMTAQVTRFKCGGFALGLAMNHCMFDGIGAMEFVNSWAETARGVAELTVPPFLDRSVLKARDPPVHTFPHHEFAEIPDVSDTAALYGAQELQYRSFCFDPDRLERVRGLALADGALGRCTTFEALSGLVWRARTKALGLAPGQRTKLLFAVDGRRRFVPPLPRGYFGNGIVLTNALATAGELLSAPVSRAAGLVQEAVRMVTDDYMRSAVDYFEATRARPSLASTLLITTWSRLEFHGADFGWGEPVMSGPVTLPEKEVILFLAHGKERKSINVLLGLPATAMDAFQELVDEI

SEQ ID NO: 6063 - protein, 453 aa, Zea mays
  misc_feature (1)..(453): useful for making plants with modified plant phenotypes as described in USSN 12/139,269
  misc_feature (1)..(453): Ceres CLONE ID no. 298205
  misc_feature (1)..(453): Utility: Useful for delaying flowering time
  misc_feature (1)..(453): Utility: Useful for making ornamental plants with modified flowers
  misc_feature (1)..(453): Utility: Useful for making ornamental plants with modified leaves
  misc_feature (1)..(453): Utility: Useful for making plants sterile and for genetic confinement
  misc_feature (1)..(453): Utility: Useful for making plants with increased biomass
  misc_feature (1)..(453): Utility: Useful for making plants with increased biomass and foliage
  misc_feature (1)..(453): Utility: Useful for making smaller plants
MVVEMKENGVAAMAAGEKAPQLGVKRGEPTLVPPAEATPTGGQYYLSNLDQNIAVIVQTVYCYKPSSPPGGGEGKDVDVAAALRDALARVLVHYHPLAGRLGVSPEMKLTVELTGEGAVFVEADAACDLAAVGDLTKPDPAALGQLVYSVPGAKHILEMPPMTAQVTRFKCGGFALGLAMNHCMFDGIGAMEFVNSWAETARGVAELTVPPFLDRSVLKARDPPVPTFPHHEFAEIPDVSDTAALYGAQELLYRSFCFDPDRLERVRGLALADGALGRCTTFEALSGLVWRARTKALGLAPEQRTKLLFAVDGRRRFAPPLPRGYFGNGIVLTNALATAGELLSAPVSRAAGLVQDAVRMVTDDYMRSAVDYFEATRARPSLASTLLITTWSRLEFHGADFGWGEPVMSGPVTLPEKEVILFLAHGKERKSINVLLGLPATAMDAFQELMDEI

SEQ ID NO: 6064 - DNA, 936 bp, Arabidopsis thaliana
  misc_feature (1)..(936): useful for making plants with modified plant phenotypes as described in USSN 12/139,269
  misc_feature (1)..(936): Ceres CLONE ID no. 158333
  misc_feature (1)..(936): Also known as  Ceres CDNA ID no. 23480081
cacgagaccattacctagaacatcctaatcgaaaaaagaaacttaatcacaactctctctttaatctctttgtctctctctctctctctctatctctctctcattttaatggcgacccaagattctcaagggattaaactctttggtaaaaccataacattcaacgccaacatcacacagacgataaaaaaagaagagcagcaacaacaacaacagccagagctacaagcaacaacagccgttagatcaccctcatcggatctgacggctgagaagcgtccagacaagatcataccatgtccgagatgcaagagcatggagactaagttttgttacttcaacaactacaacgttaatcaaccaagacacttctgcaaaggttgtcaacgttactggaccgccggtggagctctccggaatgttcccgtcggtgccggtcgtcggaagtcaaaacctcccggacgtgtcggtgggttcgctgagttgcttggagctgcgactggagctgttgatcaggtcgagctagatgctttgctagtggaagagtggagagctgctacggcgtctcacggtggtttccggcatgattttccggtgaagaggctccgttgttacaccgatggtcaatcttgttaattatttttacatttttatttgtttgttttcgggtttgggtttgggtggtttgctataatttaacccgtagaacgaaagaacgtggttaaatttgctttgctttgattactctggatacgtacaggctagcaacaaaatttaactagttaattactaattaattagtaggtttttaatacttgcttatctactaaacagctgtcgctttttaatctctcttgttgtaaattgaagctcgtggccgtgggatttttcttctctaaacaaagacggtgtggttgaccaaaaaaaaaaaaaaaa

SEQ ID NO: 6065 - protein, 175 aa, Arabidopsis thaliana
  misc_feature (1)..(175): useful for making plants with modified plant phenotypes as described in USSN 12/139,269
  misc_feature (57)..(119): Pfam Name: zf-Dof; Pfam Description: Dof domain, zinc finger
  misc_feature (1)..(175): Utility: Useful for delaying flowering time
  misc_feature (1)..(175): Utility: Useful for increasing chlorophyll and photosynthetic capacity
  misc_feature (1)..(175): Utility: Useful for increasing seed/fruit yield or modifying fruit content
  misc_feature (1)..(175): Utility: Useful for making larger plants
  misc_feature (1)..(175): Utility: Useful for making ornamental plants with modified leaves
  misc_feature (1)..(175): Utility: Useful for making plants sterile and for genetic confinement
  misc_feature (1)..(175): Utility: Useful for making plants that grow better in shade
  misc_feature (1)..(175): Utility: Useful for making plants with altered leaf shape eg curled leaves
  misc_feature (1)..(175): Utility: Useful for making plants with increased biomass
  misc_feature (1)..(175): Utility: Useful for making plants with increased biomass and foliage
  misc_feature (1)..(175): Utility: Useful for making smaller plants
  misc_feature (1)..(175): Utility: Useful for modifying fruit shape, composition and seed yield
MATQDSQGIKLFGKTITFNANITQTIKKEEQQQQQQPELQATTAVRSPSSDLTAEKRPDKIIPCPRCKSMETKFCYFNNYNVNQPRHFCKGCQRYWTAGGALRNVPVGAGRRKSKPPGRVGGFAELLGAATGAVDQVELDALLVEEWRAATASHGGFRHDFPVKRLRCYTDGQSC

SEQ ID NO: 6066 - protein, 152 aa, Brassica napus
  misc_feature (1)..(152): useful for making plants with modified plant phenotypes as described in USSN 12/139,269
  misc_feature (1)..(152): Ceres CLONE ID no. 1118660
  misc_feature (1)..(152): Utility: Useful for delaying flowering time
  misc_feature (1)..(152): Utility: Useful for increasing chlorophyll and photosynthetic capacity
  misc_feature (1)..(152): Utility: Useful for increasing seed/fruit yield or modifying fruit content
  misc_feature (1)..(152): Utility: Useful for making larger plants
  misc_feature (1)..(152): Utility: Useful for making ornamental plants with modified leaves
  misc_feature (1)..(152): Utility: Useful for making plants sterile and for genetic confinement
  misc_feature (1)..(152): Utility: Useful for making plants that grow better in shade
  misc_feature (1)..(152): Utility: Useful for making plants with altered leaf shape eg curled leaves
  misc_feature (1)..(152): Utility: Useful for making plants with increased biomass
  misc_feature (1)..(152): Utility: Useful for making plants with increased biomass and foliage
  misc_feature (1)..(152): Utility: Useful for making smaller plants
  misc_feature (1)..(152): Utility: Useful for modifying fruit shape, composition and seed yield
  misc_feature (39)..(39): Xaa is any aa, unknown or other
KKLSYNSLFSIYISLIFMATKDSPGIKLFGKTITFNADXNNIIQTIKKEEGQEQQPELQTKTAVRSPSSSDLMAEKRPDKIIACPRCKSMETKFCYFNNYNVNQPRHFCKGCQRYWTAGGALRNVPVGAGRRRSKPPGRAGGFSELLGAATG

SEQ ID NO: 6067 - protein, 170 aa, Brassica napus
  misc_feature (1)..(170): useful for making plants with modified plant phenotypes as described in USSN 12/139,269
  misc_feature (1)..(170): Public GI no. 62319965
  misc_feature (1)..(170): Utility: Useful for delaying flowering time
  misc_feature (1)..(170): Utility: Useful for increasing chlorophyll and photosynthetic capacity
  misc_feature (1)..(170): Utility: Useful for increasing seed/fruit yield or modifying fruit content
  misc_feature (1)..(170): Utility: Useful for making larger plants
  misc_feature (1)..(170): Utility: Useful for making ornamental plants with modified leaves
  misc_feature (1)..(170): Utility: Useful for making plants sterile and for genetic confinement
  misc_feature (1)..(170): Utility: Useful for making plants that grow better in shade
  misc_feature (1)..(170): Utility: Useful for making plants with altered leaf shape eg curled leaves
  misc_feature (1)..(170): Utility: Useful for making plants with increased biomass
  misc_feature (1)..(170): Utility: Useful for making plants with increased biomass and foliage
  misc_feature (1)..(170): Utility: Useful for making smaller plants
  misc_feature (1)..(170): Utility: Useful for modifying fruit shape, composition and seed yield
MATQDSQGIKLFGKTIAFNTRTIKNEEETHPPEQEATIAVRSSSSSDLTAEKRPDKIIACPRCKSMETKFCYFNNYNVNQPRHFCKGCHRYWTAGGALRNVPVGAGRRKSKPPGRVVVGMLGDGNGVRQVELINGLLVEEWQHAAAAAHGSFRHDFPMKRLRCYSDGQSC

SEQ ID NO: 6068 - DNA, 848 bp, Zea mays
  misc_feature (1)..(848): useful for making plants with modified plant phenotypes as described in USSN 12/139,269
  misc_feature (1)..(848): Ceres CLONE ID no. 225157
  misc_feature (1)..(848): Also known as  Ceres CDNA ID no. 23749861
acgatacatgcagctagctcaagggaaaggcaagagactccttgctagccatggccttctactatgcaatagcattgcttggcatgcttgctgtcttctcctcgggggggaatgcactcgatgacaatatgctgaaaaccacggtatacatacaacagcttccctatcaaaaccagagaggtgtagcagaaggtacggcagtaattagctggtacataaaggatgggccaggtgcttctgcgaatacaatcgggcatgcggagggcctggtaatcttgacagatatagccaggtcttcgtggctaatcactacggacttggtgttcgacggtggaagcctcgcagggtcctcacttcaagtgatggggcagcatgagtcttcaggccagtggagcattatgggcggcactggacaatttaccatggcacgaggtgttatagagtacaaaacaatccaagaggacagtagcagcaggacctttgaagtatgcatatatgcatactacactcccatgaacggatggaaagccggtctggctttaggtgacactggcagtaaaccttgaggactacgatcgagatttagacgaccatccatgtgtgcgcgcgccaatgcaaggagtgacgtacggcagccagatctacaatctttttttatgcttcatccaataataaatgaaccccactcccttatattatgaattagaaaaacacaatcatttgttgtattattccagacaacgaatttatttgcagtttattcagttattttctgtctcatgcatgttccccttgtctcaacagtggtcatcaataagacgtgtcttcggtggaaatatattaattgt

SEQ ID NO: 6069 - protein, 171 aa, Zea mays
  misc_feature (1)..(171): useful for making plants with modified plant phenotypes as described in USSN 12/139,269
  misc_feature (59)..(150): Pfam Name: Dirigent; Pfam Description: Dirigent-like protein
  misc_feature (59)..(150): Pfam Name: Dirigent; Pfam Description: Dirigent-like protein
  misc_feature (1)..(171): Utility: Useful for delaying flowering time
  misc_feature (1)..(171): Utility: Useful for increasing chlorophyll and photosynthetic capacity
MAFYYAIALLGMLAVFSSGGNALDDNMLKTTVYIQQLPYQNQRGVAEGTAVISWYIKDGPGASANTIGHAEGLVILTDIARSSWLITTDLVFDGGSLAGSSLQVMGQHESSGQWSIMGGTGQFTMARGVIEYKTIQEDSSSRTFEVCIYAYYTPMNGWKAGLALGDTGSKP

SEQ ID NO: 6070 - DNA, 674 bp, Zea mays
  misc_feature (1)..(674): useful for making plants with modified plant phenotypes as described in USSN 12/139,269
  misc_feature (1)..(674): Ceres CLONE ID no. 227651
  misc_feature (1)..(674): Also known as  Ceres CDNA ID no. 23742072
aaaaccctagcttgcagcgccgcctggatcgagcagccgagcgactaagcgaagactcccttttccccgagcacaagagaaccatggcggcggcggcagtttacggcggcttcaaagggaagcttggcgtcgaggatgcccccgagctgcagctcaaccgcatccgcatcacactctcatccaagaacgtcaagaacttggagaaagtttgtgcggatttggtaaagggagccaaggacaagcatttgagggttaagggacctgtcaggatccctactaaggttctccacatcaccactcgcaagtccccttgcggtgaaggaacaaacacatgggatcggtttgagttccgcattcacaagagggtgattgacctaatcagctcccctgatgtggtgaagcagatcacctccatcacaattgagcccggtgttgaggttgaggtgaccattgccgacgtgtaaggacgtgaagttcagcaatgtcatcgacaatctttttctttgtgctccctgtgacctgtgtgctcgcaagagagattttgagttattattagcatacaacacttcttcccccctataattctatgttagctgtttgtctgatttatggcctgttcaacttgaaattttgattcagtaatctttatgtggtgctaattgaacttggatcgc

SEQ ID NO: 6071 - protein, 126 aa, Zea mays
  misc_feature (1)..(126): useful for making plants with modified plant phenotypes as described in USSN 12/139,269
  misc_feature (26)..(121): Pfam Name: Ribosomal_S10; Pfam Description: Ribosomal protein S10p/S20e
  misc_feature (1)..(126): Utility: Useful for delaying flowering time
  misc_feature (1)..(126): Utility: Useful for making larger plants
  misc_feature (1)..(126): Utility: Useful for making ornamental plants with modified leaves
  misc_feature (1)..(126): Utility: Useful for making plants with increased biomass
MAAAAVYGGFKGKLGVEDAPELQLNRIRITLSSKNVKNLEKVCADLVKGAKDKHLRVKGPVRIPTKVLHITTRKSPCGEGTNTWDRFEFRIHKRVIDLISSPDVVKQITSITIEPGVEVEVTIADV

SEQ ID NO: 6072 - protein, 117 aa, Glycine max
  misc_feature (1)..(117): useful for making plants with modified plant phenotypes as described in USSN 12/139,269
  misc_feature (1)..(117): Ceres CLONE ID no. 628769
  misc_feature (1)..(117): Utility: Useful for delaying flowering time
  misc_feature (1)..(117): Utility: Useful for making larger plants
  misc_feature (1)..(117): Utility: Useful for making ornamental plants with modified leaves
  misc_feature (1)..(117): Utility: Useful for making plants with increased biomass
MKPTKPGLEESQEQIHKIRITLSSKNVKNLEKVCADLVRGAKDKHLRVKGPVRMPTKVLNITTRKSPCGEGTNTWDRFELRVHKRVIDLYSSPDVVKQITSITIEPGVEVKVTIADA

SEQ ID NO: 6073 - protein, 116 aa, Glycine max
  misc_feature (1)..(116): useful for making plants with modified plant phenotypes as described in USSN 12/139,269
  misc_feature (1)..(116): Ceres CLONE ID no. 620287
  misc_feature (1)..(116): Utility: Useful for delaying flowering time
  misc_feature (1)..(116): Utility: Useful for making larger plants
  misc_feature (1)..(116): Utility: Useful for making ornamental plants with modified leaves
  misc_feature (1)..(116): Utility: Useful for making plants with increased biomass
MKPNKPGLEESQEQIHKIRITLSSKHVKNLEKVCGDLVRGAKDKRLRVKGPVRMPTKVLHITTRKSPCGEGTNTWDRFELRVHKRVIDLYSSPDVVKQITSITIEPGVEVEVTIAD

SEQ ID NO: 6074 - protein, 117 aa, Glycine max
  misc_feature (1)..(117): useful for making plants with modified plant phenotypes as described in USSN 12/139,269
  misc_feature (1)..(117): Ceres CLONE ID no. 691483
  misc_feature (1)..(117): Utility: Useful for delaying flowering time
  misc_feature (1)..(117): Utility: Useful for making larger plants
  misc_feature (1)..(117): Utility: Useful for making ornamental plants with modified leaves
  misc_feature (1)..(117): Utility: Useful for making plants with increased biomass
  misc_feature (71)..(71): Xaa is any aa, unknown or other
  misc_feature (109)..(109): Xaa is any aa, unknown or other
MKPTKPGLEESQEQIHKIRITLSSKNVKNLEKVCADLVRGAKDKHLRVKGPVRMPTKVLNITTRKSPCGEXTNTWDRFELRVHKRVIDLYSSPDVVKQITSITIEPGVXVEVTIADA

SEQ ID NO: 6075 - protein, 117 aa, Arabidopsis thaliana
  misc_feature (1)..(117): useful for making plants with modified plant phenotypes as described in USSN 12/139,269
  misc_feature (1)..(117): Ceres CLONE ID no. 8700
  misc_feature (1)..(117): Utility: Useful for delaying flowering time
  misc_feature (1)..(117): Utility: Useful for making larger plants
  misc_feature (1)..(117): Utility: Useful for making ornamental plants with modified leaves
  misc_feature (1)..(117): Utility: Useful for making plants with increased biomass
MKPTKAGLEAPLEQIHKIRITLSSKNVKNLEKVCTDLVRGAKDKRLRVKGPVRMPTKVLKITTRKAPCGEGTNTWDRFELRVHKRVIDLFSSPDVVKQITSITIEPGVEVEVTIADS

SEQ ID NO: 6076 - protein, 117 aa, Zea mays
  misc_feature (1)..(117): useful for making plants with modified plant phenotypes as described in USSN 12/139,269
  misc_feature (1)..(117): Ceres CLONE ID no. 1387338
  misc_feature (1)..(117): Utility: Useful for delaying flowering time
  misc_feature (1)..(117): Utility: Useful for making larger plants
  misc_feature (1)..(117): Utility: Useful for making ornamental plants with modified leaves
  misc_feature (1)..(117): Utility: Useful for making plants with increased biomass
MKQGKTGFEAPQEQIHKIRITLSSKNVKNLEKVCTDLVRGAKDKRLRVKGPVRMPTKVLKITTRKAPCGEGTNTWDRFELRVHKRVIDLFSSPDVVKQITSITIEPGVEVEVTIADS

SEQ ID NO: 6077 - protein, 117 aa, Triticum aestivum
  misc_feature (1)..(117): useful for making plants with modified plant phenotypes as described in USSN 12/139,269
  misc_feature (1)..(117): Ceres CLONE ID no. 761484
  misc_feature (1)..(117): Utility: Useful for delaying flowering time
  misc_feature (1)..(117): Utility: Useful for making larger plants
  misc_feature (1)..(117): Utility: Useful for making ornamental plants with modified leaves
  misc_feature (1)..(117): Utility: Useful for making plants with increased biomass
MKSGKLGFEGTQEVQHRIRITLSSKSVKNLEKVCSDLVKGAKEKQLKVKGPVRMPTKVLNITTRKSPCGEGTNTWDRFEMRVHKRVIDLVSSPDVVKQITSITIEPGVEVEVTISDQ

SEQ ID NO: 6078 - protein, 127 aa, Triticum aestivum
  misc_feature (1)..(127): useful for making plants with modified plant phenotypes as described in USSN 12/139,269
  misc_feature (1)..(127): Ceres CLONE ID no. 615315
  misc_feature (1)..(127): Utility: Useful for delaying flowering time
  misc_feature (1)..(127): Utility: Useful for making larger plants
  misc_feature (1)..(127): Utility: Useful for making ornamental plants with modified leaves
  misc_feature (1)..(127): Utility: Useful for making plants with increased biomass
MATELAYAPPMKSGKAGFEGPQEAQHRIRITLSSKSVKNLEKVCSDLVRGAKDKLLRVKGPVRMPTKVLNITTRKSPCGEGTNTWDRFEMRVHKRVIDLVSSPDVVKQITSITIEPGVEVEVTISDQ

SEQ ID NO: 6079 - protein, 117 aa, Triticum aestivum; identical to SEQ ID NO: 6077
  misc_feature (1)..(117): useful for making plants with modified plant phenotypes as described in USSN 12/139,269
  misc_feature (1)..(117): Ceres CLONE ID no. 1326610
  misc_feature (1)..(117): Utility: Useful for delaying flowering time
  misc_feature (1)..(117): Utility: Useful for making larger plants
  misc_feature (1)..(117): Utility: Useful for making ornamental plants with modified leaves
  misc_feature (1)..(117): Utility: Useful for making plants with increased biomass

SEQ ID NO: 6080 - protein, 127 aa, Triticum aestivum; identical to SEQ ID NO: 6078
  misc_feature (1)..(127): useful for making plants with modified plant phenotypes as described in USSN 12/139,269
  misc_feature (1)..(127): Ceres CLONE ID no. 757080
  misc_feature (1)..(127): Utility: Useful for delaying flowering time
  misc_feature (1)..(127): Utility: Useful for making larger plants
  misc_feature (1)..(127): Utility: Useful for making ornamental plants with modified leaves
  misc_feature (1)..(127): Utility: Useful for making plants with increased biomass

SEQ ID NO: 6081 - protein, 117 aa, Glycine max
  misc_feature (1)..(117): useful for making plants with modified plant phenotypes as described in USSN 12/139,269
  misc_feature (1)..(117): Ceres CLONE ID no. 1417385
  misc_feature (1)..(117): Utility: Useful for delaying flowering time
  misc_feature (1)..(117): Utility: Useful for making larger plants
  misc_feature (1)..(117): Utility: Useful for making ornamental plants with modified leaves
  misc_feature (1)..(117): Utility: Useful for making plants with increased biomass
  misc_feature (116)..(116): Xaa is any aa, unknown or other
  misc_feature (117)..(117): Xaa is any aa, unknown or other
MKSGKLGFEGTQEVQHRIRITLSSKSVKNLEKVCSDLVKGAKEKQLKVKGPVRMPTKVLNITTRKSPCGEGTNTWDRFEMRVHKRVIDLVSSPDVVKQITSITIEPGVEVEVTISXX

SEQ ID NO: 6082 - protein, 117 aa, Glycine max
  misc_feature (1)..(117): useful for making plants with modified plant phenotypes as described in USSN 12/139,269
  misc_feature (1)..(117): Ceres CLONE ID no. 1057479
  misc_feature (1)..(117): Utility: Useful for delaying flowering time
  misc_feature (1)..(117): Utility: Useful for making larger plants
  misc_feature (1)..(117): Utility: Useful for making ornamental plants with modified leaves
  misc_feature (1)..(117): Utility: Useful for making plants with increased biomass
MKQGKTGLEEPQEQIHKIRITLSSKNVKNLEKVCTDLVRGAKDKRLRVKGPVRMPTKVLKITTRKAPCGEGTNTWDRFELRVHKRVIDLFSSPDVVKQITSITIEPGVEVEVTIADS

SEQ ID NO: 6083 - protein, 117 aa, Zea mays
  misc_feature (1)..(117): useful for making plants with modified plant phenotypes as described in USSN 12/139,269
  misc_feature (1)..(117): Ceres CLONE ID no. 1443563
  misc_feature (1)..(117): Utility: Useful for delaying flowering time
  misc_feature (1)..(117): Utility: Useful for making larger plants
  misc_feature (1)..(117): Utility: Useful for making ornamental plants with modified leaves
  misc_feature (1)..(117): Utility: Useful for making plants with increased biomass
MKQGKTGFEEPQEQIHKIRITLSSKNVKNLEKVCTDLVRGAKDKRLRVKGPVRMPTKVLKITTRKAPCGEGTNTWDRFELRVHKRVIDLFSSPDVVKQITSITIEPGVEVEVTIADS

SEQ ID NO: 6084 - protein, 117 aa, Zea mays; identical to SEQ ID NO: 6082
  misc_feature (1)..(117): useful for making plants with modified plant phenotypes as described in USSN 12/139,269
  misc_feature (1)..(117): Ceres CLONE ID no. 1386515
  misc_feature (1)..(117): Utility: Useful for delaying flowering time
  misc_feature (1)..(117): Utility: Useful for making larger plants
  misc_feature (1)..(117): Utility: Useful for making ornamental plants with modified leaves
  misc_feature (1)..(117): Utility: Useful for making plants with increased biomass

SEQ ID NO: 6085 - protein, 122 aa, Brassica napus
  misc_feature (1)..(122): useful for making plants with modified plant phenotypes as described in USSN 12/139,269
  misc_feature (1)..(122): Ceres CLONE ID no. 1068506
  misc_feature (1)..(122): Utility: Useful for delaying flowering time
  misc_feature (1)..(122): Utility: Useful for making larger plants
  misc_feature (1)..(122): Utility: Useful for making ornamental plants with modified leaves
  misc_feature (1)..(122): Utility: Useful for making plants with increased biomass
MAYAAMKPTKAGLEEPLEQIHKIRITLSSKNVKNLEKVCADLVRGAKDKRLRTKGPVRMPTKVLKITTRKAPCGEGTNTWDRFELRVHKRVIDLFSSPDVVKQITSITIEPGVEVEVTIADS

SEQ ID NO: 6086 - protein, 122 aa, Brassica napus; identical to SEQ ID NO: 6085
  misc_feature (1)..(122): useful for making plants with modified plant phenotypes as described in USSN 12/139,269
  misc_feature (1)..(122): Ceres CLONE ID no. 1081109
  misc_feature (1)..(122): Utility: Useful for delaying flowering time
  misc_feature (1)..(122): Utility: Useful for making larger plants
  misc_feature (1)..(122): Utility: Useful for making ornamental plants with modified leaves
  misc_feature (1)..(122): Utility: Useful for making plants with increased biomass

SEQ ID NO: 6087 - protein, 122 aa, Glycine max; identical to SEQ ID NO: 6085
  misc_feature (1)..(122): useful for making plants with modified plant phenotypes as described in USSN 12/139,269
  misc_feature (1)..(122): Ceres CLONE ID no. 1070341
  misc_feature (1)..(122): Utility: Useful for delaying flowering time
  misc_feature (1)..(122): Utility: Useful for making larger plants
  misc_feature (1)..(122): Utility: Useful for making ornamental plants with modified leaves
  misc_feature (1)..(122): Utility: Useful for making plants with increased biomass

SEQ ID NO: 6088 - DNA, 1024 bp, Zea mays
  misc_feature (1)..(1024): useful for making plants with modified plant phenotypes as described in USSN 12/139,269
  misc_feature (1)..(1024): Ceres CLONE ID no. 235672
  misc_feature (1)..(1024): Also known as  Ceres CDNA ID no. 23784995
acagagcgccacgaggcgagcagtcgagtgttccctagagtccccgttcctccgccgccgcctgcaaccgcttcacgtgccctgatccatcgcaggtcccctttctgaccccaaatggagccgaagaagtcctctgctcagcaccagccccacgccatggaacccaagaagtcctctccacgcggcgccggggccgtcgccgccaccgccactgaagccgagtccccgttgagcagcttgttctacccgccggcgcccgcggcaaatgggaaagatcaggagttgtacagcattatttacaaagggcagagcgggagcgcacaagctggcgcgacaggtaatggtaaaccgcaatgggctccttccaaaagtcataccgcgtacgcaaaggacggtaaacattcaccaccttatgatacgtcatgttttgggtcatctgtgcattatggtggtcgagattatttctacggcagctctacaaccaagaaagcgacagaatcctccactgactacaaaggggacaagaaagatccagtcgcagattctcatggcgactggtggcaaggctcattttattactaagagaacctggtggcctctccttggagaacaaggaacagaaggaggggcagtgaagctcggtttccttgattgctagcagtattatcttgtgtcatagtggacccgctttcgtccagtggtggtgcgccaatatttagaagcgtcacctggcctgggcagatgtagtgtgcgtcttatagtctctgctttagatgtgcaatgtaacgaagctttagcacagtatgaactagaccgcataaaagaatccatgtccattccgccagtaatatgagcgggttggtatctgactccttagagtcaaaattctgtacaattggatcgtcgctccaaagcaaaaaaaaaaaacaataataatgtgctggagaagcggcgatgacttcacattgtacacctttaccagctggaatttgacagaagtttggaaactgttcttgtcaattgc

SEQ ID NO: 6089 - protein, 75 aa, Zea mays
  misc_feature (1)..(75): useful for making plants with modified plant phenotypes as described in USSN 12/139,269
  misc_feature (1)..(75): Utility: Useful for delaying flowering time
  misc_feature (1)..(75): Utility: Useful for making larger plants
  misc_feature (1)..(75): Utility: Useful for making plants with increased biomass and foliage
  misc_feature (1)..(75): Utility: Useful for making plants with increased size and biomass
  misc_feature (69)..(69): Xaa is any aa, unknown or other
MEPKKSSAQHQPHAMEPKKSSPRGAGAVAATATEAESPLSSLFYPPAPAANGKDQELYSIIYKGQSGSXTSWRDR

SEQ ID NO: 6090 - protein, 75 aa, Zea mays; identical to SEQ ID NO: 6089
  misc_feature (1)..(75): useful for making plants with modified plant phenotypes as described in USSN 12/139,269
  misc_feature (1)..(75): Ceres CLONE ID no. 235672
  misc_feature (1)..(75): Utility: Useful for delaying flowering time
  misc_feature (1)..(75): Utility: Useful for making larger plants
  misc_feature (1)..(75): Utility: Useful for making plants with increased biomass and foliage
  misc_feature (1)..(75): Utility: Useful for making plants with increased size and biomass
  misc_feature (69)..(69): Xaa is any aa, unknown or other

SEQ ID NO: 6091 - protein, 156 aa, Zea mays; identical to SEQ ID NO: 2909
  misc_feature (1)..(156): useful for making plants with modified plant phenotypes as described in USSN 12/139,269
  misc_feature (1)..(156): Public GI no. 56784045
  misc_feature (1)..(156): Utility: Useful for delaying flowering time
  misc_feature (1)..(156): Utility: Useful for making larger plants
  misc_feature (1)..(156): Utility: Useful for making plants with increased biomass and foliage
  misc_feature (1)..(156): Utility: Useful for making plants with increased size and biomass

SEQ ID NO: 6092 - DNA, 1290 bp, Zea mays
  misc_feature (1)..(1290): useful for making plants with modified plant phenotypes as described in USSN 12/139,269
  misc_feature (1)..(1290): Ceres CLONE ID no. 241131
  misc_feature (1)..(1290): Also known as  Ceres CDNA ID no. 23773411
  misc_feature (564)..(564): k is g or t/u
ttttcctcccataaaagcctctccctccgctagtccgctctcaagtaaaaagctcccgaaatcccctcacctactcctctccctctccctctggcagcgccgcctcgccggcggttgcctgcctgcaccttcgccccccgtctcgacctcgacgcggcctccgttcctccgcgagacgcagcatggatgtgcgccctgcgaatgcggccgacgactcgtctctcggagacctgttcccgcaccagcccgccggtttggagagtgacgagagcaacacagaatggctctctggttacgtagaggactgcttttcgagctccacgtcgtacacaaatcccgtctctgcaatggcaagcgagggtgtcggaaaaccaaagctacctccaccaccatcctccaacggcaggagaaagaaacggagcttggcctccgtcatgaccaacggcgactaccaacaattcgtcctcccgctgtacgtcgagccaccgctgatcctgatcgaccagaaacactggatggcagagagcgagctgatccaccccaagaaggacgacgacgaccgakaggtttgccagcaacaagggcaggagcaagagaagggcgtgccgcggctggtgaagatgtgcagcaactgtctgtcaagccaaacgccacggtggagggacgggccgtcggggcgccagatgatgtgcagcgcatgcggcatgaggctcaagccagagaccaggttgtcagccgagcagcagtacggccaggaagaacccaccaggaaggagcaagagccagacaggaagaggaagaaggcggccaagaagacgtgctacgagagcagcgacgccccgccgtcgtcggaccagcaagagaagcggtgcgcccactgcctgtcctccaagaccccgcagtggagggcggggcctctggggcccaagaccctgtgcaacgcctgcggcgtcaggttcaagtccggcaggctgctgcccgagtaccggcccgccaacagccccaccttcgtgagctgcttgcactccaactcccacaagaaggtcatgcagatgcggcaggccgtcgcgcagcagcagtgaggccgacgtctcccggaatctatcgttggaagcgcgttaggggatctcttagatcgtagcttagtcgatgctcagagaggatgagaacagagactttggttatagtagtagtaggcaatcgtcgttagctctagcggtgttctagctcagactgatttgctcggtgtttttagacgtcggattcaatacaatctcgatgttgtcctgg

SEQ ID NO: 6093 - protein, 299 aa, Zea mays
  misc_feature (1)..(299): useful for making plants with modified plant phenotypes as described in USSN 12/139,269
  misc_feature (230)..(265): Pfam Name: GATA; Pfam Description: GATA zinc finger
  misc_feature (1)..(299): Utility: Useful for delaying flowering time
  misc_feature (1)..(299): Utility: Useful for making plants with altered leaf shape eg curled leaves
  misc_feature (1)..(299): Utility: Useful for making smaller plants
MDVRPANAADDSSLGDLFPHQPAGLESDESNTEWLSGYVEDCFSSSTSYTNPVSAMASEGVGKPKLPPPPSSNGRRKKRSLASVMTNGDYQQFVLPLYVEPPLILIDQKHWMAESELIHPKKDDDDREVCQQQGQEQEKGVPRLVKMCSNCLSSQTPRWRDGPSGRQMMCSACGMRLKPETRLSAEQQYGQEEPTRKEQEPDRKRKKAAKKTCYESSDAPPSSDQQEKRCAHCLSSKTPQWRAGPLGPKTLCNACGVRFKSGRLLPEYRPANSPTFVSCLHSNSHKKVMQMRQAVAQQQ

SEQ ID NO: 6094 - protein, 99 aa, Glycine max
  misc_feature (1)..(99): useful for making plants with modified plant phenotypes as described in USSN 12/139,269
  misc_feature (1)..(99): Ceres CLONE ID no. 674257
  misc_feature (1)..(99): Utility: Useful for delaying flowering time
  misc_feature (1)..(99): Utility: Useful for making plants with altered leaf shape eg curled leaves
  misc_feature (1)..(99): Utility: Useful for making smaller plants
  misc_feature (9)..(9): Xaa is any aa, unknown or other
  misc_feature (46)..(46): Xaa is any aa, unknown or other
  misc_feature (57)..(57): Xaa is any aa, unknown or other
  misc_feature (94)..(94): Xaa is any aa, unknown or other
MSKESFGDXELEEGSNGQQPMPTRRCSHCLAQRTPQWRAGPLGPKXLCNACGVRYKXGRLLPEYRPAKSPTFVSYLHSNSHKKVMEMRMAVFSXISSEQ

SEQ ID NO: 6095 - protein, 111 aa, Glycine max
  misc_feature (1)..(111): useful for making plants with modified plant phenotypes as described in USSN 12/139,269
  misc_feature (1)..(111): Ceres CLONE ID no. 621746
  misc_feature (1)..(111): Utility: Useful for delaying flowering time
  misc_feature (1)..(111): Utility: Useful for making plants with altered leaf shape eg curled leaves
  misc_feature (1)..(111): Utility: Useful for making smaller plants
MAKEDEEKVIINVSKEISFGDSELDEGSNGQQQPMPRRCTHCLAQRTPQWRAGPLGPKTLCNACGVRYKSGRLLPEYRPAKSPTFVSYLHSNSHKKVMEMRMSVYSISSEQ

SEQ ID NO: 6096 - protein, 250 aa, Arabidopsis thaliana
  misc_feature (1)..(250): useful for making plants with modified plant phenotypes as described in USSN 12/139,269
  misc_feature (1)..(250): Ceres CLONE ID no. 1334990
  misc_feature (1)..(250): Utility: Useful for delaying flowering time
  misc_feature (1)..(250): Utility: Useful for making plants with altered leaf shape eg curled leaves
  misc_feature (1)..(250): Utility: Useful for making smaller plants
MFPALPSDLTSCPKGAARVRIPNNMIPALKQSCSSEALSGINSTPHQSSAPPDIKVSYLFQSLTPVSVLENSYGSLSTQNSGSQRLAFPVKGMRSKRRRPTTVRLSYLFPFEPRKSTPGESVTEGYYSSEQHAKKKRKIHLITHTESSTLESSKSDGIVRICTHCETITTPQWRQGPSGPKTLCNACGVRFKSGRLVPEYRPASSPTFIPSVHSNSHRKIIEMRKKDDEFDTSMIRSDIQKVKQGRKKMV

SEQ ID NO: 6097 - protein, 247 aa, Arabidopsis thaliana
  misc_feature (1)..(247): useful for making plants with modified plant phenotypes as described in USSN 12/139,269
  misc_feature (1)..(247): Ceres CLONE ID no. 18857
  misc_feature (1)..(247): Utility: Useful for delaying flowering time
  misc_feature (1)..(247): Utility: Useful for making plants with altered leaf shape eg curled leaves
  misc_feature (1)..(247): Utility: Useful for making smaller plants
MDMFPTLPSDLTSCGSGMAKAPRVDIQRNIPALKQSYSSEALSSTLHQSSAPPEIKVSKLFQSLSPVSVLENSYGSLSTHNNGSQRLAFPVKGMRSKRKRPTTLRLSYLFPSEPRKPEKSTPGKPESECYFSSEQHAKKKRKIHLTTRTVSSTLEASNSDGIVRKCTHCETTKTPQWREGPSGPKTLCNACGVRFRSGRLVPEYRPASSPTFIPAVHSNSHRKIIEMRRKDDEQFDSSMIRAVISRG

SEQ ID NO: 6098 - DNA, 910 bp, Arabidopsis thaliana
  misc_feature (1)..(910): useful for making plants with modified plant phenotypes as described in USSN 12/139,269
  misc_feature (1)..(910): Ceres CLONE ID no. 262460
  misc_feature (1)..(910): Also known as  Ceres CDNA ID no. 23365397
atcaactctctctctcactttcacaactctccctttctatttctctctctagaaaaatatcatcatctatcaattatatagagtacttatttagattcatttcataaaaatggagaaaagagaaagtagtggtggttctggatcaggagatgcagaggtgagaaaagggccatggacgatggaagaagatttgattctcatcaattatatcgccaatcatggtgaaggtgtttggaactctctcgccaaatctgcaggactaaaacgcaccgggaaaagttgccggctccggtggctgaactacctccgacctgatgtgcgacggggaaatatcacaccagaagaacagctcaccatcatggaacttcatgcaaaatggggaaataggtggtcaaaaattgcaaagcatttaccaggaaggaccgacaatgagataaagaacttttggaggactaagatccagaaatacatcatcaagagcggagaaacgacgaccgttggatcacaaagctccgagtttataaaccatcatgcgacaacgagccatgtcatgaatgatactcaagaaaccatggatatgtattctccaacgacgtcgtatcaacatgccagcaatattaatcagcagcttaattatggtaattatgtgcctgaatccagttcgatcatgatgccattatctgttgatcaatccgaacaaaactattggagcgtcgatgatctttggcccatgaatatatataatggtaattaataaataagttcgttaaaacttatatatatttacggtccaaagagggttctatataaacagagtactgtatgggtttgcctcattgtttagaggtaggtacttaatataaggttggagatcttatatgaattaataaataactcgtatttactagat

SEQ ID NO: 6099 - protein, 191 aa, Arabidopsis thaliana
  misc_feature (1)..(191): useful for making plants with modified plant phenotypes as described in USSN 12/139,269
  misc_feature (2)..(43): Pfam Name: Myb_DNA-binding; Pfam Description: Myb-like DNA-binding domain
  misc_feature (1)..(191): Utility: Useful for delaying flowering time
  misc_feature (1)..(191): Utility: Useful for making larger plants
  misc_feature (1)..(191): Utility: Useful for making ornamental plants with modified leaves
  misc_feature (1)..(191): Utility: Useful for making plants with altered leaf shape eg curled leaves
  misc_feature (1)..(191): Utility: Useful for making plants with increased biomass
  misc_feature (1)..(191): Utility: Useful for making plants with increased biomass and foliage
  misc_feature (1)..(191): Utility: Useful for making smaller plants
MEEDLILINYIANHGEGVWNSLAKSAGLKRTGKSCRLRWLNYLRPDVRRGNITPEEQLTIMELHAKWGNRWSKIAKHLPGRTDNEIKNFWRTKIQKYIIKSGETTTVGSQSSEFINHHATTSHVMNDTQETMDMYSPTTSYQHASNINQQLNYGNYVPESSSIMMPLSVDQSEQNYWSVDDLWPMNIYNGN

SEQ ID NO: 6100 - protein, 226 aa, Arabidopsis thaliana
  misc_feature (1)..(226): useful for making plants with modified plant phenotypes as described in USSN 12/139,269
  misc_feature (1)..(226): Public GI no. 26451911
  misc_feature (1)..(226): Utility: Useful for delaying flowering time
  misc_feature (1)..(226): Utility: Useful for making larger plants
  misc_feature (1)..(226): Utility: Useful for making ornamental plants with modified leaves
  misc_feature (1)..(226): Utility: Useful for making plants with altered leaf shape eg curled leaves
  misc_feature (1)..(226): Utility: Useful for making plants with increased biomass
  misc_feature (1)..(226): Utility: Useful for making plants with increased biomass and foliage
  misc_feature (1)..(226): Utility: Useful for making smaller plants
MEKRGGGSSGGSGSSAEAEVRKGPWTMEEDLILINYIANHGDGVWNSLAKSAGLKRTGKSCRLRWLNYLRPDVRRGNITPEEQLIIMELHAKWGNRWSKIAKHLPGRTDNEIKNFWRTRIQKYIKQSDVTTTSSVGSHHSSEINDQAASTSSHNVFCTQDQAMETYSPTPTSYQHTNMEFNYGNYSAAAVTATVDYPVPMTVDDQTGENYWGMDDIWSSMHLLNGN

SEQ ID NO: 6101 - protein, 182 aa, Glycine max
  misc_feature (1)..(182): useful for making plants with modified plant phenotypes as described in USSN 12/139,269
  misc_feature (1)..(182): Ceres CLONE ID no. 549651
  misc_feature (1)..(182): Utility: Useful for delaying flowering time
  misc_feature (1)..(182): Utility: Useful for making larger plants
  misc_feature (1)..(182): Utility: Useful for making ornamental plants with modified leaves
  misc_feature (1)..(182): Utility: Useful for making plants with altered leaf shape eg curled leaves
  misc_feature (1)..(182): Utility: Useful for making plants with increased biomass
  misc_feature (1)..(182): Utility: Useful for making plants with increased biomass and foliage
  misc_feature (1)..(182): Utility: Useful for making smaller plants
  misc_feature (11)..(11): Xaa is any aa, unknown or other
  misc_feature (13)..(13): Xaa is any aa, unknown or other
  misc_feature (102)..(102): Xaa is any aa, unknown or other
  misc_feature (151)..(151): Xaa is any aa, unknown or other
  misc_feature (174)..(174): Xaa is any aa, unknown or other
  misc_feature (177)..(177): Xaa is any aa, unknown or other
MEEDLILITYXAXHGEGVWNSLAKAAGLKRTGKSCRLRWLNYLRPDVRRGNITPEEQLLIMELHAKWGNRWSKIAKHLPGRTDNEIKNYWRTRIQKHLMQAXSSFQQQSSNSEIIYHPQACTSQVSTMAQPIETYSPPSYQGMLDPFSIQXPTNPHHSSCCPMTTTTLLLEHGXYLXCISHY

SEQ ID NO: 6102 - protein, 226 aa, Glycine max
  misc_feature (1)..(226): useful for making plants with modified plant phenotypes as described in USSN 12/139,269
  misc_feature (1)..(226): Public GI no. 2280528
  misc_feature (1)..(226): Utility: Useful for delaying flowering time
  misc_feature (1)..(226): Utility: Useful for making larger plants
  misc_feature (1)..(226): Utility: Useful for making ornamental plants with modified leaves
  misc_feature (1)..(226): Utility: Useful for making plants with altered leaf shape eg curled leaves
  misc_feature (1)..(226): Utility: Useful for making plants with increased biomass
  misc_feature (1)..(226): Utility: Useful for making plants with increased biomass and foliage
  misc_feature (1)..(226): Utility: Useful for making smaller plants
MEKRGGGSSGGSGSSAEAEVRKGPWTMEEDLILINYIANHGDGVWNSLAKSAGLKRTGKSCRLRWLNYLRPDVRRGNITPEEQLIIMELHAKWGNRWSKIAKHLPGRTDNEIKNFCRTRIQKYIKQSDVTTTSSVGSHHSSEINDQAASTSSHNVFCTQDQAMETYSPTPTSYQHTNMEFNYGNYSAAAVTATVDYPVPMTVDDQTGENYWGMDDIWSSMHLLNGN

SEQ ID NO: 6103 - protein, 204 aa, Glycine max
  misc_feature (1)..(204): useful for making plants with modified plant phenotypes as described in USSN 12/139,269
  misc_feature (1)..(204): Ceres CLONE ID no. 544897
  misc_feature (1)..(204): Utility: Useful for delaying flowering time
  misc_feature (1)..(204): Utility: Useful for making larger plants
  misc_feature (1)..(204): Utility: Useful for making ornamental plants with modified leaves
  misc_feature (1)..(204): Utility: Useful for making plants with altered leaf shape eg curled leaves
  misc_feature (1)..(204): Utility: Useful for making plants with increased biomass
  misc_feature (1)..(204): Utility: Useful for making plants with increased biomass and foliage
  misc_feature (1)..(204): Utility: Useful for making smaller plants
MDKKLGNTSHDPEVRKGPWTMEEDLILITYIANHGEGVWNSLAKAAGLKRTGKSCRLRWLNYLRPDVRRGNITPEEQLLIMELHAKWGNRWSKIAKHLPGRTDNEIKNYWRTRIQKHLKQASSSFQQQSSNSEIIYHPQACTSQVSTMAQPIETYSPPSYQGMLDPFSIQFPTNPHHSSCCTNDDDNNNYWSMEDIWSMQLANY

SEQ ID NO: 6104 - protein, 217 aa, Glycine max
  misc_feature (1)..(217): useful for making plants with modified plant phenotypes as described in USSN 12/139,269
  misc_feature (1)..(217): Public GI no. 1841475
  misc_feature (1)..(217): Utility: Useful for delaying flowering time
  misc_feature (1)..(217): Utility: Useful for making larger plants
  misc_feature (1)..(217): Utility: Useful for making ornamental plants with modified leaves
  misc_feature (1)..(217): Utility: Useful for making plants with altered leaf shape eg curled leaves
  misc_feature (1)..(217): Utility: Useful for making plants with increased biomass
  misc_feature (1)..(217): Utility: Useful for making plants with increased biomass and foliage
  misc_feature (1)..(217): Utility: Useful for making smaller plants
MDKKPCNSSQDPEVRKGPWTMEEDLILINYIANHGEGVWNSLAKAAGLKRTGKSCRLRWLNYLRPDVRRGNITPEEQLLIMELHSKWGNRWSKIAKHLPGRTDNEIKNFWRTRIQKHIKQVDNPNQQNFQQKMSLEINDHHHHHPHQPSSSQVSNLVEPMETYSPTSYQGTLEPFPTQFPTINNDHHQNSNCCANDNNNNNYWSMEDIWSMQLLNGD

SEQ ID NO: 6105 - DNA, 467 bp, Arabidopsis thaliana
  misc_feature (1)..(467): useful for making plants with modified plant phenotypes as described in USSN 12/139,269
  misc_feature (1)..(467): Ceres CLONE ID no. 270555
  misc_feature (1)..(467): Also known as  Ceres CDNA ID no. 23557625
gataacaaattttcactgtcttgtcattcttctcatctcctagacaaaggaaactcaggagatgagaagaaaattttggtggttgtttataaactataatataatacacatcaaatctttgacacgataccaacttaaagaagaagaagaagaagctgcattgatcttcccaaaagatcctccatggttcaaggcatggatggttcctgtgatgatgcttttcgttttctttgtattttctattgtaggaatttgtcgacgttgtcgcaattgtcgccgtggtgaaaattctcccagcattcatcctattaactaattatttagattttttttcctttttcttttctttctataatatgtaaatcattgttggtgaaatgtaaaattttacagtttcaccatatcgatttcttatcgctttgatctaatgaaagcaaaaaagaataaatatgccaaagattaaggat

SEQ ID NO: 6106 - protein, 84 aa, Arabidopsis thaliana
  misc_feature (1)..(84): useful for making plants with modified plant phenotypes as described in USSN 12/139,269
  misc_feature (1)..(84): Utility: Useful for delaying flowering time
  misc_feature (1)..(84): Utility: Useful for making plants with increased biomass and foliage
  misc_feature (1)..(84): Utility: Useful for making smaller plants
MRRKFWWLFINYNIIHIKSLTRYQLKEEEEEAALIFPKDPPWFKAWMVPVMMLFVFFVFSIVGICRRCRNCRRGENSPSIHPIN

SEQ ID NO: 6107 - protein, 85 aa, Brassica napus
  misc_feature (1)..(85): useful for making plants with modified plant phenotypes as described in USSN 12/139,269
  misc_feature (1)..(85): Ceres CLONE ID no. 1087479
  misc_feature (1)..(85): Utility: Useful for delaying flowering time
  misc_feature (1)..(85): Utility: Useful for making plants with increased biomass and foliage
  misc_feature (1)..(85): Utility: Useful for making smaller plants
MGRNIWWLFLNNEIRHIKSFTRYEVKDEEAALIFPKDPPWFKLWMVPVMMLFIFFIVVVILICRRCQNCRRGENSPSIHPISQNT

SEQ ID NO: 6108 - DNA, 1159 bp, Glycine max
  misc_feature (1)..(1159): useful for making plants with modified plant phenotypes as described in USSN 12/139,269
  misc_feature (1)..(1159): Ceres CLONE ID no. 481710
  misc_feature (1)..(1159): Also known as  Ceres CDNA ID no. 23664396
atatatatccctcactcactctatctcttttctccagcagcaccaaaaccacccaacactcgaactcaatatccattattaccaaaaaaaaagaaaaaaggatatcaaacacccttttcatcattaaaactctcagttccctctttccctatcaaaaccctttcccacaacactactcactccagtacaagaaaccctttttcaatttggtttcaacagcacacacacacacacatatatatatatatagcatgtttaccttgaatcattcttctgatttgtaccatgtttcccctgagctctcatcttccttggacacatcctcgccggcttcggagggctctcgtggcgtggcattttccgacgaggaggtgcggctggcggtgaggcacccgaagaagcgggcaggtcggaagaagttccgggagacgcgccacccggtgtaccggggggtgaggaggaggaactcggataagtgggtgtgtgaggtgagggagcccaacaagaagaccaggatttggctggggactttccccacgccggagatggcggctcgggcgcacgacgtggcggcaatggccctgaggggccggtatgcctgtctaaactttgctgactcggcctggcggttacctgttcccgccacggccgaggcaaaggatatacagaaggcagcagcagaagctgcccaggctttcagaccagatcaaaccttaaaaaatgctaatacaaggcaggagtgtgtggaggcggtggcggtggcggtggcggagacaacaacggcgacggcacaaggggtgttttatatggaggaagaagagcaggtgttggatatgcctgagttgcttaggaatatggtgctcatgtccccaacacattgcttagggtatgagtatgaagatgctgacttggatgcccaagatgctgaggtgtcactatggaatttctcaatttaataatgtgttttggtttggtttttgttgttagttttttggagtgaacagtgtctgtactggttttttattagtagtacggatactagttataggtggaaagattgcgagggaccaaaaggaattttcttttgaacccttttttgtcaatgtaatcaatatcacgtatatcatgaagtgaatcccttcaagtttatgtataaatt

SEQ ID NO: 6109 - protein, 234 aa, Glycine max
  misc_feature (1)..(234): useful for making plants with modified plant phenotypes as described in USSN 12/139,269
  misc_feature (63)..(126): Pfam Name: AP2; Pfam Description: AP2 domain
  misc_feature (63)..(126): Pfam Name: AP2; Pfam Description: AP2 domain
  misc_feature (1)..(234): Utility: Useful for delaying flowering time
  misc_feature (1)..(234): Utility: Useful for increasing chlorophyll and photosynthetic capacity
  misc_feature (1)..(234): Utility: Useful for making plants with increased biomass and foliage
  misc_feature (1)..(234): Utility: Useful for making smaller plants
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVAETTTATAQGVFYMEEEEQVLDMPELLRNMVLMSPTHCLGYEYEDADLDAQDAEVSLWNFSI

SEQ ID NO: 6110 - protein, 215 aa, Glycine max
  misc_feature (1)..(215): useful for making plants with modified plant phenotypes as described in USSN 12/139,269
  misc_feature (1)..(215): Public GI no. 37147896
  misc_feature (1)..(215): Utility: Useful for delaying flowering time
  misc_feature (1)..(215): Utility: Useful for increasing chlorophyll and photosynthetic capacity
  misc_feature (1)..(215): Utility: Useful for making plants with increased biomass and foliage
  misc_feature (1)..(215): Utility: Useful for making smaller plants
MNIFRSYYSDPLTESSSSFSDSSIYSPNRAIFSDEEVILASNNPKKPAGRKKFRETRHPVYRGVRKRNSGKWVCEVREPNKKSRIWLGTFPTAEMAARAHDVAAIALRGRSACLNFADSAWRLPVPASSDTKDIQKAAAEAAEAFRPLKLEGISKESSSSTPESMFFMDEEALFCMPGLLTNMAEGLMLPPPQCAEIGDHVETADADTPLWSYSI

SEQ ID NO: 6111 - protein, 215 aa, Glycine max
  misc_feature (1)..(215): useful for making plants with modified plant phenotypes as described in USSN 12/139,269
  misc_feature (1)..(215): Public GI no. 40647095
  misc_feature (1)..(215): Utility: Useful for delaying flowering time
  misc_feature (1)..(215): Utility: Useful for increasing chlorophyll and photosynthetic capacity
  misc_feature (1)..(215): Utility: Useful for making plants with increased biomass and foliage
  misc_feature (1)..(215): Utility: Useful for making smaller plants
MNIFRSYYSDPLTESSSSFSDSSIYSPNRAIFSDEEVILASNNPKKPAGRKKFRETRHPVYRGVRKRNSGKWVCEVREPNKKSRIWLGTFPTAEMAARAHDVAAIALRGRSACLNFADSAWRLPVPASSDTKDIQKAAAEAAEALRPLKLEGISKESSSSTPESMFFMDEEALFCMPGLLTNMAEGLMLPPPQCAEIGDHVETADADTPLWSYSI

SEQ ID NO: 6112 - protein, 205 aa, Glycine max
  misc_feature (1)..(205): useful for making plants with modified plant phenotypes as described in USSN 12/139,269
  misc_feature (1)..(205): Public GI no. 45826358
  misc_feature (1)..(205): Utility: Useful for delaying flowering time
  misc_feature (1)..(205): Utility: Useful for increasing chlorophyll and photosynthetic capacity
  misc_feature (1)..(205): Utility: Useful for making plants with increased biomass and foliage
  misc_feature (1)..(205): Utility: Useful for making smaller plants
MFYSDPRIESCSSFSDSIRANHSDEEVILASNNPKKPAGRKKFRETRHPVYRGVRKRNSGKWVCEVREPNKKTRIWLGTFPTAEMAARAHDVAAIALRGRSACLNFADSAWRLPTPDSSDTKDIQKAAAQAAEIFRPLKSEEEESVVKDQSTTPDDMFFMDEEALFCMPGLLTNMAEGLMVPPPQCTEMGDHVEADDMPLWSYSI

SEQ ID NO: 6113 - protein, 176 aa, Parthenium argentatum
  misc_feature (1)..(176): useful for making plants with modified plant phenotypes as described in USSN 12/139,269
  misc_feature (1)..(176): Ceres CLONE ID no. 1604576
  misc_feature (1)..(176): Utility: Useful for delaying flowering time
  misc_feature (1)..(176): Utility: Useful for increasing chlorophyll and photosynthetic capacity
  misc_feature (1)..(176): Utility: Useful for making plants with increased biomass and foliage
  misc_feature (1)..(176): Utility: Useful for making smaller plants
MELKLASQNPKKRAGRKKFKETRHPIYRGVRRRNSEKWVCEVREPNKQSRVWLGTYPTAEMAARAHDVAVLAMRGRSACLNFADSVWRLPVPESSNVKDIQKAAAEAAEAFRETEDIAVETNEVPEVVVYADEEEMFGMPEFIDSMAEGMMLPPPQMVGDANFVDNVDFWGDLSLW

SEQ ID NO: 6114 - protein, 216 aa, Parthenium argentatum
  misc_feature (1)..(216): useful for making plants with modified plant phenotypes as described in USSN 12/139,269
  misc_feature (1)..(216): Public GI no. 41351817
  misc_feature (1)..(216): Utility: Useful for delaying flowering time
  misc_feature (1)..(216): Utility: Useful for increasing chlorophyll and photosynthetic capacity
  misc_feature (1)..(216): Utility: Useful for making plants with increased biomass and foliage
  misc_feature (1)..(216): Utility: Useful for making smaller plants
MNSFSAFAEMFGSEYESPVTVGGDYCPTLATSCPKKPAGRKKFRETRHPIYRGVRRRNSGKWVCEVREPNKKSRIWLGTFPTAEMAARAHDVAAIALRGRSACLNFADSAWRLRIPESTCAKDIQKAAAEAAVAFQAEMSDTMTSDHGLDMEETTVEVIVTEEEQSEGFYMDEEAMFGMPRLLANMAEGMLLPPPSVQWGHNYDCDGDADVSLWSY

SEQ ID NO: 6115 - protein, 219 aa, Parthenium argentatum
  misc_feature (1)..(219): useful for making plants with modified plant phenotypes as described in USSN 12/139,269
  misc_feature (1)..(219): Public GI no. 12003384
  misc_feature (1)..(219): Utility: Useful for delaying flowering time
  misc_feature (1)..(219): Utility: Useful for increasing chlorophyll and photosynthetic capacity
  misc_feature (1)..(219): Utility: Useful for making plants with increased biomass and foliage
  misc_feature (1)..(219): Utility: Useful for making smaller plants
MDIFRSYYSDPLAEYSSISDSSSSSCNRANHSDEEVMLASNNPKKRAGRKKFRETRHPVYRGVRKRNSDKWVCELREPNKKSRIWLGTFPSAEMAARAHDVAAIALRGRSACLNFADSAWKLPIPASTDAKDIQKAAAEAAEAFRSSEAENMPEYSGEDTKEVNSTPENMFYMDEEALFFMPGLLVNMAEGLMLPPPQCSQIGDHMEADVDMPLWSYSI

SEQ ID NO: 6116 - protein, 207 aa, Arabidopsis thaliana
  misc_feature (1)..(207): useful for making plants with modified plant phenotypes as described in USSN 12/139,269
  misc_feature (1)..(207): Ceres CLONE ID no. 1014380
  misc_feature (1)..(207): Utility: Useful for delaying flowering time
  misc_feature (1)..(207): Utility: Useful for increasing chlorophyll and photosynthetic capacity
  misc_feature (1)..(207): Utility: Useful for making plants with increased biomass and foliage
  misc_feature (1)..(207): Utility: Useful for making smaller plants
MFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 6117 - protein, 210 aa, Arabidopsis thaliana
  misc_feature (1)..(210): useful for making plants with modified plant phenotypes as described in USSN 12/139,269
  misc_feature (1)..(210): Public GI no. 45826359
  misc_feature (1)..(210): Utility: Useful for delaying flowering time
  misc_feature (1)..(210): Utility: Useful for increasing chlorophyll and photosynthetic capacity
  misc_feature (1)..(210): Utility: Useful for making plants with increased biomass and foliage
  misc_feature (1)..(210): Utility: Useful for making smaller plants
MNIFETYYSDSLILTESSSSSSSSSFSEEEVILASNNPKKPAGRKKFRETRHPIYRGIRKRNSGKWVCEVREPNKKTRIWLGTFPTAEMAARAHDVAALALRGRSACLNFSDSAWRLPIPASSNSKDIQKAAAQAVEIFRSEEVSGESPETSENVQESSDFVDEEAIFFMPGLLANMAEGLMLPPPQCAEMGDHCVETDAYMITLWNYSI

SEQ ID NO: 6118 - protein, 240 aa, Arabidopsis thaliana
  misc_feature (1)..(240): useful for making plants with modified plant phenotypes as described in USSN 12/139,269
  misc_feature (1)..(240): Public GI no. 49658405
  misc_feature (1)..(240): Utility: Useful for delaying flowering time
  misc_feature (1)..(240): Utility: Useful for increasing chlorophyll and photosynthetic capacity
  misc_feature (1)..(240): Utility: Useful for making plants with increased biomass and foliage
  misc_feature (1)..(240): Utility: Useful for making smaller plants
MDMFFSQLSDSVDQPQSSLLSDASVTTRGASCSDGDVILASSRPKKRAGRRVFKETRHPVYRGVRRRNNDKWVCEMREPNKKKSRIWLGTYPTAEMAARAHDVAALAFRGKLACINFADSAWRLPVPASMDTMDIRRAAAEAAEGFRPVEFGGVCSGSSDEKERMVVQVEEKNKKGSVNLERSRSLSLSYWDEEEVFHMPRLLHDMAEGLLLSPSQCLGGYMNLDDMGTDADVKLWSFSI

SEQ ID NO: 6119 - DNA, 1050 bp, Glycine max
  misc_feature (1)..(1050): useful for making plants with modified plant phenotypes as described in USSN 12/139,269
  misc_feature (1)..(1050): Ceres CLONE ID no. 482122
  misc_feature (1)..(1050): Also known as  Ceres CDNA ID no. 23664111
  misc_feature (698)..(698): r is g or a
  misc_feature (770)..(770): r is g or a
aactctcactccacaactcaactaagcgcaaaccaaaccaacacaaacaaaaacatctctcagcaaatgaatattctcggacaatcactccaccaatcaaacaacggcagctactcttgttcgtcgccggagactgcaaactcctctaaccttccgaccactccgaaagccgttcactccgacgaggaagtgaacacattagcatcggctcatcctaagaaacgtgcggggcgtcgaatttttaaggagacaaggcatcccgtgtacagaggagtgcggcggaggaacaacaacaagtgggtctgcgaggttcgtgttcccaacgacaagtccacgaggatttggctcggaacgtatccaacgcctgagatggccgcacgtgcgcacgacgtcgccgcgctctcgcttcgaggtaagtcggcgtgtctcaacttcgccgactcgggcgtggcggttgcccttgccggcgtcgaccaatgcgaaggagattcggcgcgtggcggcggcggctgctgtagcgattgcggcggaagacagccgcggcaagcagttgcggactaatgcgattgatgccgttgctgattgcgaagttagcagcagtgacataggcgtcgatgaaaattgcaataacaataaagcttcgcagaggttttgtgatttggatgaaattacaatgccagatgcaccggtttttgagracatgcatgagtggcttcagactatggctgctgaaccattaagatcacctacttttgtaacatatgttaatrttagggatgtctggaactttgtggaggatgatgctgaggtttccttgtggagcttcaccgtctgaagagcatgcaatttaggctttaggtgtatttagtgtgtttagctttctttctcttcttttggtttttgtacataattaggaacggaggactacgaaaatgtacaaagaccgaaacgatataaggagatagctatctaggtaggaacataaaagtgtgaaacattgtaacttttctcattcggttgtttttgtaaaataaaaattctattttcatc

SEQ ID NO: 6120 - protein, 255 aa, Glycine max
  misc_feature (1)..(255): useful for making plants with modified plant phenotypes as described in USSN 12/139,269
  misc_feature (65)..(129): Pfam Name: AP2; Pfam Description: AP2 domain
  misc_feature (65)..(129): Pfam Name: AP2; Pfam Description: AP2 domain
  misc_feature (1)..(255): Utility: Useful for delaying flowering time
  misc_feature (1)..(255): Utility: Useful for increasing chlorophyll and photosynthetic capacity
  misc_feature (1)..(255): Utility: Useful for making plants sterile and for genetic confinement
  misc_feature (1)..(255): Utility: Useful for making shorter plants and plants with modified flowers
  misc_feature (1)..(255): Utility: Useful for making smaller plants
MNILGQSLHQSNNGSYSCSSPETANSSNLPTTPKAVHSDEEVNTLASAHPKKRAGRRIFKETRHPVYRGVRRRNNNKWVCEVRVPNDKSTRIWLGTYPTPEMAARAHDVAALSLRGKSACLNFADSAWRLPLPASTNAKEIRRVAAAAAVAIAAEDSRGKQLRTNAIDAVADCEVSSSDIGVDENCNNNKASQRFCDLDEITMPDAPVFEDMHEWLQTMAAEPLRSPTFVTYVNVRDVWNFVEDDAEVSLWSFTV

SEQ ID NO: 6121 - protein, 215 aa, Glycine max; identical to SEQ ID NO: 6110
  misc_feature (1)..(215): useful for making plants with modified plant phenotypes as described in USSN 12/139,269
  misc_feature (1)..(215): Public GI no. 37147896
  misc_feature (1)..(215): Utility: Useful for delaying flowering time
  misc_feature (1)..(215): Utility: Useful for increasing chlorophyll and photosynthetic capacity
  misc_feature (1)..(215): Utility: Useful for making plants sterile and for genetic confinement
  misc_feature (1)..(215): Utility: Useful for making shorter plants and plants with modified flowers
  misc_feature (1)..(215): Utility: Useful for making smaller plants

SEQ ID NO: 6122 - protein, 215 aa, Glycine max; identical to SEQ ID NO: 6111
  misc_feature (1)..(215): useful for making plants with modified plant phenotypes as described in USSN 12/139,269
  misc_feature (1)..(215): Public GI no. 40647095
  misc_feature (1)..(215): Utility: Useful for delaying flowering time
  misc_feature (1)..(215): Utility: Useful for increasing chlorophyll and photosynthetic capacity
  misc_feature (1)..(215): Utility: Useful for making plants sterile and for genetic confinement
  misc_feature (1)..(215): Utility: Useful for making shorter plants and plants with modified flowers
  misc_feature (1)..(215): Utility: Useful for making smaller plants

SEQ ID NO: 6123 - protein, 219 aa, Glycine max; identical to SEQ ID NO: 6115
  misc_feature (1)..(219): useful for making plants with modified plant phenotypes as described in USSN 12/139,269
  misc_feature (1)..(219): Public GI no. 12003384
  misc_feature (1)..(219): Utility: Useful for delaying flowering time
  misc_feature (1)..(219): Utility: Useful for increasing chlorophyll and photosynthetic capacity
  misc_feature (1)..(219): Utility: Useful for making plants sterile and for genetic confinement
  misc_feature (1)..(219): Utility: Useful for making shorter plants and plants with modified flowers
  misc_feature (1)..(219): Utility: Useful for making smaller plants

SEQ ID NO: 6124 - protein, 226 aa, Glycine max
  misc_feature (1)..(226): useful for making plants with modified plant phenotypes as described in USSN 12/139,269
  misc_feature (1)..(226): Ceres CLONE ID no. 1609048
  misc_feature (1)..(226): Utility: Useful for delaying flowering time
  misc_feature (1)..(226): Utility: Useful for increasing chlorophyll and photosynthetic capacity
  misc_feature (1)..(226): Utility: Useful for making plants sterile and for genetic confinement
  misc_feature (1)..(226): Utility: Useful for making shorter plants and plants with modified flowers
  misc_feature (1)..(226): Utility: Useful for making smaller plants
MNIFKSPLDHDLNCGGIFHDSAEASYSSETRSTPSDEEVILASARPKKRAGRRVFKETRHPVYRGVRRRNKNKWVCEMRVPNNNSRIWLGTYPTPEMAARAHDVAALALRGKSACLNFADSRWRLTVPATTNAEEIRRAAGEAAEAFAVADGDDVNIDQQQSVMATNDDEVQEPLQQEEVQDLHDLLLSIANEPLMSPPPCARDGRDWNDVDIFDDDEISLWNFSI

SEQ ID NO: 6125 - protein, 219 aa, Glycine max
  misc_feature (1)..(219): useful for making plants with modified plant phenotypes as described in USSN 12/139,269
  misc_feature (1)..(219): Public GI no. 38683266
  misc_feature (1)..(219): Utility: Useful for delaying flowering time
  misc_feature (1)..(219): Utility: Useful for increasing chlorophyll and photosynthetic capacity
  misc_feature (1)..(219): Utility: Useful for making plants sterile and for genetic confinement
  misc_feature (1)..(219): Utility: Useful for making shorter plants and plants with modified flowers
  misc_feature (1)..(219): Utility: Useful for making smaller plants
MNSSFSAFSEMFGSEYESPVSSGGGDYCPTLATSCPKKPAGRKKFRETRHPVYRGVRRRNSGKWVCEVREPNKKSRIWLGTFPTADMAARAHDVAAIALRGRSACLNFADSAWRLRIPESTGAKEIQKAAAEAALAFQDEMMMSDTTTTDHGFDMEETFVEAIVTAEQSASLYIDEEDMFGMPSLMASMAEGMLLPLPSVQWNHNYDIDGDDDVSLWSY

SEQ ID NO: 6126 - protein, 234 aa, Glycine max
  misc_feature (1)..(234): useful for making plants with modified plant phenotypes as described in USSN 12/139,269
  misc_feature (1)..(234): Public GI no. 55824656
  misc_feature (1)..(234): Utility: Useful for delaying flowering time
  misc_feature (1)..(234): Utility: Useful for increasing chlorophyll and photosynthetic capacity
  misc_feature (1)..(234): Utility: Useful for making plants sterile and for genetic confinement
  misc_feature (1)..(234): Utility: Useful for making shorter plants and plants with modified flowers
  misc_feature (1)..(234): Utility: Useful for making smaller plants
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVADTTTATAQGVFYMEEEEQVLDMPELLRNMVLMSPTHCLGYEYEDADLDAQDAEVSLWNFSI

SEQ ID NO: 6127 - protein, 207 aa, Arabidopsis thaliana; identical to SEQ ID NO: 6116
  misc_feature (1)..(207): useful for making plants with modified plant phenotypes as described in USSN 12/139,269
  misc_feature (1)..(207): Ceres CLONE ID no. 1014380
  misc_feature (1)..(207): Utility: Useful for delaying flowering time
  misc_feature (1)..(207): Utility: Useful for increasing chlorophyll and photosynthetic capacity
  misc_feature (1)..(207): Utility: Useful for making plants sterile and for genetic confinement
  misc_feature (1)..(207): Utility: Useful for making shorter plants and plants with modified flowers
  misc_feature (1)..(207): Utility: Useful for making smaller plants

SEQ ID NO: 6128 - protein, 234 aa, Glycine max; identical to SEQ ID NO: 6109
  misc_feature (1)..(234): useful for making plants with modified plant phenotypes as described in USSN 12/139,269
  misc_feature (1)..(234): Ceres CLONE ID no. 481710
  misc_feature (1)..(234): Utility: Useful for delaying flowering time
  misc_feature (1)..(234): Utility: Useful for increasing chlorophyll and photosynthetic capacity
  misc_feature (1)..(234): Utility: Useful for making plants sterile and for genetic confinement
  misc_feature (1)..(234): Utility: Useful for making shorter plants and plants with modified flowers
  misc_feature (1)..(234): Utility: Useful for making smaller plants

SEQ ID NO: 6129 - protein, 234 aa, Glycine max; identical to SEQ ID NO: 6109
  misc_feature (1)..(234): useful for making plants with modified plant phenotypes as described in USSN 12/139,269
  misc_feature (1)..(234): Public GI no. 33304979
  misc_feature (1)..(234): Utility: Useful for delaying flowering time
  misc_feature (1)..(234): Utility: Useful for increasing chlorophyll and photosynthetic capacity
  misc_feature (1)..(234): Utility: Useful for making plants sterile and for genetic confinement
  misc_feature (1)..(234): Utility: Useful for making shorter plants and plants with modified flowers
  misc_feature (1)..(234): Utility: Useful for making smaller plants

SEQ ID NO: 6130 - protein, 232 aa, Glycine max
  misc_feature (1)..(232): useful for making plants with modified plant phenotypes as described in USSN 12/139,269
  misc_feature (1)..(232): Public GI no. 23495458
  misc_feature (1)..(232): Utility: Useful for delaying flowering time
  misc_feature (1)..(232): Utility: Useful for increasing chlorophyll and photosynthetic capacity
  misc_feature (1)..(232): Utility: Useful for making plants sterile and for genetic confinement
  misc_feature (1)..(232): Utility: Useful for making shorter plants and plants with modified flowers
  misc_feature (1)..(232): Utility: Useful for making smaller plants
MDMIYSQLSDLASMENPDTSSFSDASVTARRASLSDEEVILASSCPKRRAGRRVFKETRHPVYRGVRRRNNNKWVCELRAPNNKKARIWLGTYPTAEMAARAHDVAVLAFRGKLACLNFADSAWRLPVPASTDAAEIRRAATEAAEAFRQAEDGGVDEKESKAVVSEEKGCVGMEGSSNLFYLDEDEIFEMPRLLDDMADGIMLCPPQCLDGYMDWNDVETVDDLKLWSFSI

SEQ ID NO: 6131 - protein, 231 aa, Glycine max
  misc_feature (1)..(231): useful for making plants with modified plant phenotypes as described in USSN 12/139,269
  misc_feature (1)..(231): Ceres CLONE ID no. 1620272
  misc_feature (1)..(231): Utility: Useful for delaying flowering time
  misc_feature (1)..(231): Utility: Useful for increasing chlorophyll and photosynthetic capacity
  misc_feature (1)..(231): Utility: Useful for making plants sterile and for genetic confinement
  misc_feature (1)..(231): Utility: Useful for making shorter plants and plants with modified flowers
  misc_feature (1)..(231): Utility: Useful for making smaller plants
MYTLNHSSYLYHVSPELSSSLDSSSPASEGSRGVAFSDEEVRLAVRHPKKRAGRKKFRETRHPVYRGVRRRNTDKWVSEVREPNKKTRIWLGTFPTPEMAARAHDVAAMALRGRYACLNFADSTWRLPIPATANAKDIQKAAAEAAEAFRPSQTLENTNTKQECVKVVTTTTITEQKRGMFYMEEEEQVLDMPELLRNMVLMSPTHCIGYEYEDADLDAQDAEVSLWSFSI

SEQ ID NO: 6132 - protein, 240 aa, Glycine max; identical to SEQ ID NO: 6118
  misc_feature (1)..(240): useful for making plants with modified plant phenotypes as described in USSN 12/139,269
  misc_feature (1)..(240): Public GI no. 49658405
  misc_feature (1)..(240): Utility: Useful for delaying flowering time
  misc_feature (1)..(240): Utility: Useful for increasing chlorophyll and photosynthetic capacity
  misc_feature (1)..(240): Utility: Useful for making plants sterile and for genetic confinement
  misc_feature (1)..(240): Utility: Useful for making shorter plants and plants with modified flowers
  misc_feature (1)..(240): Utility: Useful for making smaller plants

SEQ ID NO: 6133 - DNA, 680 bp, Glycine max
  misc_feature (1)..(680): useful for making plants with modified plant phenotypes as described in USSN 12/139,269
  misc_feature (1)..(680): Ceres CLONE ID no. 536457
  misc_feature (1)..(680): Also known as  Ceres CDNA ID no. 23689039
  misc_feature (634)..(634): y is t/u or c
aagtgtgagtgatatttgagcttaaaccctagccgctcttctcttcattcttcactttggaaacaatcataatggcgttctgtaataaggttggaaatgtcttgaggcagggtgctgctcgcagcacacatgcccctgttgcgtccatgcttaattacatccgctgcatgtcttcaagcaagcttttcattggaggcctttcatatggagttgatgaccagtctcttaaggatgcattttctggctttggagatgtggttgatgcaaaagttataactgatagagacagtggaagatcaaggggatttggatttgtcaacttctccaatgatgagtctgcaagttcggcactctctgcaatggacgggaaggatctaaatgggcgaagcattcgggtatcctatgcaaatgataaaccatctgcacctcgacctggtggcggtggcggttatcgtggcggggattatgatggtgattttgcttctcgtagtggtggttggtgatcaaatttttgtttgttgcgccttctgcttagttgagattttatgtttatgcctagcacttcgattaaggtggtcactcaagtggtaaagtagtaattattggaattttatgtttttccccgttacatttyttggttatgttattctgtgattttaatggagcatttgtttccatcc

SEQ ID NO: 6134 - protein, 143 aa, Glycine max
  misc_feature (1)..(143): useful for making plants with modified plant phenotypes as described in USSN 12/139,269
  misc_feature (38)..(109): Pfam Name: RRM_1; Pfam Description: RNA recognition motif. (a.k.a. RRM, RBD, or RNP domain)
  misc_feature (1)..(143): Utility: Useful for delaying flowering time
  misc_feature (1)..(143): Utility: Useful for making larger plants
  misc_feature (1)..(143): Utility: Useful for making smaller plants
MAFCNKVGNVLRQGAARSTHAPVASMLNYIRCMSSSKLFIGGLSYGVDDQSLKDAFSGFGDVVDAKVITDRDSGRSRGFGFVNFSNDESASSALSAMDGKDLNGRSIRVSYANDKPSAPRPGGGGGYRGGDYDGDFASRSGGW

SEQ ID NO: 6135 - protein, 113 aa, Glycine max
  misc_feature (1)..(113): useful for making plants with modified plant phenotypes as described in USSN 12/139,269
  misc_feature (1)..(113): Ceres CLONE ID no. 744170
  misc_feature (1)..(113): Utility: Useful for delaying flowering time
  misc_feature (1)..(113): Utility: Useful for making larger plants
  misc_feature (1)..(113): Utility: Useful for making smaller plants
MLNYIRCMSSSKLFIGGLSYGVDDQSLKDAFSGFGDVVDAKVITDRDSGRSRGFGFVNFSNDESASSALSAMDGKDLDGRSIRVSYANDRPSGPQSGGGGGGGYRSGGFGGGW

SEQ ID NO: 6136 - protein, 150 aa, Arabidopsis thaliana
  misc_feature (1)..(150): useful for making plants with modified plant phenotypes as described in USSN 12/139,269
  misc_feature (1)..(150): Ceres CLONE ID no. 7191
  misc_feature (1)..(150): Utility: Useful for delaying flowering time
  misc_feature (1)..(150): Utility: Useful for making larger plants
  misc_feature (1)..(150): Utility: Useful for making smaller plants
MAFCNKLGGLLRQNISSNGNVPVTSMLGSLRLMSTKLFIGGLSWGTDDASLRDAFAHFGDVVDAKVIVDRETGRSRGFGFVNFNDEGAATAAISEMDGKELNGRHIRVNPANDRPSAPRAYGGGGGYSGGGGGGYGGGGGSYGGGDGGGY

SEQ ID NO: 6137 - protein, 112 aa, Brassica napus
  misc_feature (1)..(112): useful for making plants with modified plant phenotypes as described in USSN 12/139,269
  misc_feature (1)..(112): Ceres CLONE ID no. 954739
  misc_feature (1)..(112): Utility: Useful for delaying flowering time
  misc_feature (1)..(112): Utility: Useful for making larger plants
  misc_feature (1)..(112): Utility: Useful for making smaller plants
MLRYMSTKLFIGGLSPGTDDQSLKDAFSTFNGVTEARVMTNKVTGRSRGYGFVNFTSEDSAKSAISAMDGQELNGRNIRVDVAKEWPSLPFSSVEGTEDEKKGNKMVSRSVW

SEQ ID NO: 6138 - protein, 158 aa, Arabidopsis thaliana
  misc_feature (1)..(158): useful for making plants with modified plant phenotypes as described in USSN 12/139,269
  misc_feature (1)..(158): Ceres CLONE ID no. 16314
  misc_feature (1)..(158): Utility: Useful for delaying flowering time
  misc_feature (1)..(158): Utility: Useful for making larger plants
  misc_feature (1)..(158): Utility: Useful for making smaller plants
MAFCNKLGGLLRQNISSNGNVPVTSMLGSLRLMSTKLFIGGLSWGTDDASLRDAFAHFGDVVDAKVIVDRETGRSRGFGFVNFNDEGAATAAISEMDGKELNGRHIRVNPANDRPSAPRAYGGGGGYSGGGGGYGGGGGGYGGGGGGYGGGGDGGGGF

SEQ ID NO: 6139 - protein, 139 aa, Brassica napus
  misc_feature (1)..(139): useful for making plants with modified plant phenotypes as described in USSN 12/139,269
  misc_feature (1)..(139): Ceres CLONE ID no. 971630
  misc_feature (1)..(139): Utility: Useful for delaying flowering time
  misc_feature (1)..(139): Utility: Useful for making larger plants
  misc_feature (1)..(139): Utility: Useful for making smaller plants
MHLQMAVCTKLGVLQNRNVPVTSMLRYMSTKLFIGGLSPGTDDQSLKDAFSTFNGVTEARVMTNKVTGRSRGYGFVNFTSEDSAKSAISAMDGQELNGRNIRVDVAKEWPSLPFSSVEGTEDEKKGNKMVSRSVWKDPF

SEQ ID NO: 6140 - protein, 136 aa, Arabidopsis thaliana
  misc_feature (1)..(136): useful for making plants with modified plant phenotypes as described in USSN 12/139,269
  misc_feature (1)..(136): Ceres CLONE ID no. 40714
  misc_feature (1)..(136): Utility: Useful for delaying flowering time
  misc_feature (1)..(136): Utility: Useful for making larger plants
  misc_feature (1)..(136): Utility: Useful for making smaller plants
MAFCNKLSGILRQGVSQSSNGPVTSMLGSLRYMSSKLFVGGLSWGTDDSSLKQAFTSFGEVTEATVIADRETGRSRGFGFVSFSCEDSANNAIKEMDGKELNGRQIRVNLATERSSAPRSSFGGGGGYGGGGGGGY

SEQ ID NO: 6141 - protein, 136 aa, Arabidopsis thaliana
  misc_feature (1)..(136): useful for making plants with modified plant phenotypes as described in USSN 12/139,269
  misc_feature (1)..(136): Ceres CLONE ID no. 18903
  misc_feature (1)..(136): Utility: Useful for delaying flowering time
  misc_feature (1)..(136): Utility: Useful for making larger plants
  misc_feature (1)..(136): Utility: Useful for making smaller plants
MAFCNKLSGILRQGVSHSSNGPVTSMLGSLRYMSSKLFVGGLSWGTDDSSLKQAFTSFGEVTEATVIADRETGRSRGFGFVSFSCEDSANNAIKEMDGKELNGRQIRVNLATERSSAPRSSFGGGGGYGGGGGGGY

SEQ ID NO: 6142 - protein, 113 aa, Triticum aestivum
  misc_feature (1)..(113): useful for making plants with modified plant phenotypes as described in USSN 12/139,269
  misc_feature (1)..(113): Ceres CLONE ID no. 703819
  misc_feature (1)..(113): Utility: Useful for delaying flowering time
  misc_feature (1)..(113): Utility: Useful for making larger plants
  misc_feature (1)..(113): Utility: Useful for making smaller plants
MCAGQPADGSKLFVGGLAWATDDHSLKEAFQCFGEVVEARVITDRETGRSRGFGFVSFASGEDAKSAAENMDGKELAGRNVRVNSAEEEEEQTRRAKMKTILASETMEIPEEV

SEQ ID NO: 6143 - protein, 141 aa, Brassica napus
  misc_feature (1)..(141): useful for making plants with modified plant phenotypes as described in USSN 12/139,269
  misc_feature (1)..(141): Ceres CLONE ID no. 1070258
  misc_feature (1)..(141): Utility: Useful for delaying flowering time
  misc_feature (1)..(141): Utility: Useful for making larger plants
  misc_feature (1)..(141): Utility: Useful for making smaller plants
MAVCTRFRVLQNRNVAATSMLRYMSTKLFIGGLSPGTDDNSLKDAFSTFNGVTEARVMTNEVTGRSRGYGFVNFKIEESAKSAISAMDGQELNGCNIRVDAAKEWPSLPLSLGEGTEDEKKGNKMVSRSVWKDPFVDAFLM

SEQ ID NO: 6144 - DNA, 594 bp, Glycine max
  misc_feature (1)..(594): useful for making plants with modified plant phenotypes as described in USSN 12/139,269
  misc_feature (1)..(594): Ceres CLONE ID no. 536796
  misc_feature (1)..(594): Also known as  Ceres CDNA ID no. 3265003
tcacaaataaataaaaaaaattgttttcgtgtggaaacaaaaaaacaattcaaaaacaaacatatgatggtgaagccgagtagcgaaaagccagaggagcatagggattccaagtactacaaaggggtccgaaagagaaaatggggcaaatgggtatccgaaataagactacccaacagccgtcagaggatttggttgggatccttcgacacccccgagaaggccgcgcgtgccttcgacgccgcaatgttctgcttacgtggccgcaacgccaagttcaatttccccgacaacccacccgacatcgccggcggggaatccatgacgccgtcacagattcaggtcgccgccgcacaattcgccaacgctgggccccacgagggacattcgggtcgacccgaacattctcccatgcaatctctatcgccttctgtttcagaagggaccgttctaacggacagtgacgtcaccacacttaacggttcgctaacggatttgttcactcccgttgggtcgagtggttacgcatccgattacgggattttccccggtgttgatgatttcagtggcggtttttatgtgccggaaatgctg

SEQ ID NO: 6145 - protein, 177 aa, Glycine max
  misc_feature (1)..(177): useful for making plants with modified plant phenotypes as described in USSN 12/139,269
  misc_feature (17)..(80): Pfam Name: AP2; Pfam Description: AP2 domain
  misc_feature (17)..(80): Pfam Name: AP2; Pfam Description: AP2 domain
  misc_feature (1)..(177): Utility: Useful for delaying flowering time
  misc_feature (1)..(177): Utility: Useful for making larger plants
  misc_feature (1)..(177): Utility: Useful for making plants with increased biomass and foliage
  misc_feature (1)..(177): Utility: Useful for making smaller plants
MMVKPSSEKPEEHRDSKYYKGVRKRKWGKWVSEIRLPNSRQRIWLGSFDTPEKAARAFDAAMFCLRGRNAKFNFPDNPPDIAGGESMTPSQIQVAAAQFANAGPHEGHSGRPEHSPMQSLSPSVSEGTVLTDSDVTTLNGSLTDLFTPVGSSGYASDYGIFPGVDDFSGGFYVPEML

SEQ ID NO: 6146 - protein, 185 aa, Glycine max
  misc_feature (1)..(185): useful for making plants with modified plant phenotypes as described in USSN 12/139,269
  misc_feature (1)..(185): Public GI no. 29893536
  misc_feature (1)..(185): Utility: Useful for delaying flowering time
  misc_feature (1)..(185): Utility: Useful for making larger plants
  misc_feature (1)..(185): Utility: Useful for making plants with increased biomass and foliage
  misc_feature (1)..(185): Utility: Useful for making smaller plants
MEGSSSSMQSKYKGVRKRKWGKWVSEIRLPNSRERIWLGSYDTPEKAARAFDAALYCLRGNNAKFNFPDNPPVISGGRNLSRSEIREAAARFANSAEDDSSGGAGYEIRQESASTSMDVDSEFLSMLPTVGSGNFASEFGLFPGFDDFSDEYSGDRFREQLSPTQDYYQLGEETYADGSMFLWNF

SEQ ID NO: 6147 - protein, 185 aa, Brassica napus
  misc_feature (1)..(185): useful for making plants with modified plant phenotypes as described in USSN 12/139,269
  misc_feature (1)..(185): Ceres CLONE ID no. 973892
  misc_feature (1)..(185): Utility: Useful for delaying flowering time
  misc_feature (1)..(185): Utility: Useful for making larger plants
  misc_feature (1)..(185): Utility: Useful for making plants with increased biomass and foliage
  misc_feature (1)..(185): Utility: Useful for making smaller plants
MKLSPPPLTNNEQPAADTAVKSCGGGGRETFSATRHPVYHGVRKRRWGKWVSEIREPRKKSRIWLGSFPIPEMAAKAYDVAALCLKGRKAQLNFPDEIDDLPRPSTCTARDIQVAAAKAANAVKIIKTGDDVANIGDGDDFWEGIELPELMMTRCGWSPEPFVAGDDATWLVDEDSYQYQFMACL

SEQ ID NO: 6148 - protein, 186 aa, Parthenium argentatum
  misc_feature (1)..(186): useful for making plants with modified plant phenotypes as described in USSN 12/139,269
  misc_feature (1)..(186): Ceres CLONE ID no. 1609832
  misc_feature (1)..(186): Utility: Useful for delaying flowering time
  misc_feature (1)..(186): Utility: Useful for making larger plants
  misc_feature (1)..(186): Utility: Useful for making plants with increased biomass and foliage
  misc_feature (1)..(186): Utility: Useful for making smaller plants
MKPKSSEGSSSSTHEPKYKGVRLRKWGKWVSEIRLPNSRERIWLGSYDSPEKAARAFDAAAFCLRGHAAKFNFPDQPPNIPGGRSLSSAQIQDAAARYANSVPDETVIPMEDSTSSSIMLNDDSNYNNNSSSSNNNNNVTDYDIFPGFDDYFMQPPPMVSPQFADYDEGNSSDGDISQGPSFLWNY

SEQ ID NO: 6149 - protein, 149 aa, Brassica napus
  misc_feature (1)..(149): useful for making plants with modified plant phenotypes as described in USSN 12/139,269
  misc_feature (1)..(149): Ceres CLONE ID no. 1081780
  misc_feature (1)..(149): Utility: Useful for delaying flowering time
  misc_feature (1)..(149): Utility: Useful for making larger plants
  misc_feature (1)..(149): Utility: Useful for making plants with increased biomass and foliage
  misc_feature (1)..(149): Utility: Useful for making smaller plants
MSSPSSSSSSLSTSSSISKSNLAKKYKGVRMRSWGSWVSEIRAPNQKTRIWLGSYSTAEAAARAYDAALLCLKGSSASNLNFPEISSSLYNTNNGDNKNNINMSPKYIQRVAAAAANADPSSSSVSTSSPLLSSSPSEDLYDVVSMSQY

SEQ ID NO: 6150 - DNA, 919 bp, Glycine max
  misc_feature (1)..(919): useful for making plants with modified plant phenotypes as described in USSN 12/139,269
  misc_feature (1)..(919): Ceres CLONE ID no. 572121
  misc_feature (1)..(919): Also known as  Ceres CDNA ID no. 23395381
  misc_feature (899)..(899): w is a or t/u
aaacataagagaaggtttcgtggcagtggcgagtgaagaagctatgcctgatgagtgagtcatttttttctctctggtgggtcccatcctcttctgctctgagaacctttataagtgttatatgagtcattgagaagtgaccccaggaaaaagaaaagaaaagaaaaacttcacttcacttgcatgccaaatgagaacaacctcttcttagaataatttcctcggtgtttaagccttgtcgatttccgaacaccaatccgagttaattaaacaatgagagtttcgacagaaaagttagagacagagccggagagcaaaaagataaaacgcattcgtggcggcggcggcggggactcgagcaataagcaccctttgtaccgcggcgtgcggatgcggaactgggggaaatgggtgtcggaaatccgcgagccgcggaagaagtcgcggatatggctaggcacattcccgacgccggaaatggcggcgagggcgcacgacgtggcggctctcagcatcaaaggctccgccgccattctcaacttccctcactttgccaactcgctccctcgcccggcttctctcgcgccgcgcgacgttcaagccgcggcggccaaagcggcgcacatggacccttcttccctctcctcccttgtctccgcaatggacttgtcctctgcctctgacgagttgagccaaatcatagagcttccttctttggaaagcaccgatgatggctccgtcgtcttagagaaagagtttgtttttgttgactcccttgatgcttggatgtatcagccaccctttggttttgacaccgaacaagacactggtttcgagggtttgatgtggaattactagtttcgatccatgtttctgttctattctatgtcttatgttgwataaattaatattgatcgtc

SEQ ID NO: 6151 - protein, 194 aa, Glycine max
  misc_feature (1)..(194): useful for making plants with modified plant phenotypes as described in USSN 12/139,269
  misc_feature (33)..(96): Pfam Name: AP2; Pfam Description: AP2 domain
  misc_feature (1)..(194): Utility: Useful for delaying flowering time
  misc_feature (1)..(194): Utility: Useful for increasing seed/fruit yield or modifying fruit content
  misc_feature (1)..(194): Utility: Useful for making plants sterile and for genetic confinement
  misc_feature (1)..(194): Utility: Useful for modifying plant structure, ie increased branching
MRVSTEKLETEPESKKIKRIRGGGGGDSSNKHPLYRGVRMRNWGKWVSEIREPRKKSRIWLGTFPTPEMAARAHDVAALSIKGSAAILNFPHFANSLPRPASLAPRDVQAAAAKAAHMDPSSLSSLVSAMDLSSASDELSQIIELPSLESTDDGSVVLEKEFVFVDSLDAWMYQPPFGFDTEQDTGFEGLMWNY

SEQ ID NO: 6152 - protein, 155 aa, Glycine max
  misc_feature (1)..(155): useful for making plants with modified plant phenotypes as described in USSN 12/139,269
  misc_feature (1)..(155): Ceres CLONE ID no. 1169111
  misc_feature (1)..(155): Utility: Useful for delaying flowering time
  misc_feature (1)..(155): Utility: Useful for increasing seed/fruit yield or modifying fruit content
  misc_feature (1)..(155): Utility: Useful for making plants sterile and for genetic confinement
  misc_feature (1)..(155): Utility: Useful for modifying plant structure, ie increased branching
MRNWGKWVSEIREPRKKSRIWLGTFPTPEMAARAHDVAALSIKGPAAILNFPHLANSLPRPASLAPRDVQAAAAKAAHMDPSSLSSLVSAMDLSSASDELSQIIELPSLESTDDGSVDLKKEFVFVDSLDAWMYQPPFGFDTEQDTGFEGLMWNY

SEQ ID NO: 6153 - DNA, 596 bp, Glycine max
  misc_feature (1)..(596): useful for making plants with modified plant phenotypes as described in USSN 12/139,269
  misc_feature (1)..(596): Ceres CLONE ID no. 641355
  misc_feature (1)..(596): Also known as  Ceres CDNA ID no. 23400957
  misc_feature (511)..(511): k is g or t/u
  misc_feature (551)..(551): m is a or c
agaacatcctaatcgaaaaaattaattaaggcatcacaatggaagaggagtcaaaggagaaaaagaaggacactaaggaggaaccacgttatagaggagtgcggcggcggccgtgggggaagttcgcggccgagattcgggacccggcccggcacggtgcccgagtgtggctggggacatttctcacggcggaggaggctgctagggcttatgaccgagctgcctatgagatgaggggcgctttagccgttctcaattttccaaatgagtatccttcatgctcttctatgaactcatcttcaacattagcaccttcatcttcttcttcaaattcaatgcttaaaagtgatcatggtaaacaagttattgagttcgagtgcttggatgacaaattgttagaggaccttcttgattgtgatgactatgcctacgagaaagacttgcctaagaactgaacggtttgatcaaatttgaatgttagattgatttcaaagcatacctatagtagggkgaatgtcttcatatatgatatgatttccttttaggcagcmctttactttggtgagtatggtttataacttaagaatgactttgtt

SEQ ID NO: 6154 - protein, 138 aa, Glycine max
  misc_feature (1)..(138): useful for making plants with modified plant phenotypes as described in USSN 12/139,269
  misc_feature (16)..(80): Pfam Name: AP2; Pfam Description: AP2 domain
  misc_feature (1)..(138): Utility: Useful for delaying flowering time
  misc_feature (1)..(138): Utility: Useful for increasing chlorophyll and photosynthetic capacity
  misc_feature (1)..(138): Utility: Useful for making plants that grow better in shade
  misc_feature (1)..(138): Utility: Useful for making plants with enhanced abiotic stress tolerance
  misc_feature (1)..(138): Utility: Useful for making plants with increased biomass
  misc_feature (1)..(138): Utility: Useful for making plants with increased biomass and foliage
  misc_feature (1)..(138): Utility: Useful for making smaller plants
  misc_feature (1)..(138): Utility: Useful for modifying plant architecture, ie amount of branching
MEEESKEKKKDTKEEPRYRGVRRRPWGKFAAEIRDPARHGARVWLGTFLTAEEAARAYDRAAYEMRGALAVLNFPNEYPSCSSMNSSSTLAPSSSSSNSMLKSDHGKQVIEFECLDDKLLEDLLDCDDYAYEKDLPKN

SEQ ID NO: 6155 - protein, 133 aa, Glycine max
  misc_feature (1)..(133): useful for making plants with modified plant phenotypes as described in USSN 12/139,269
  misc_feature (1)..(133): Public GI no. 57012753
  misc_feature (1)..(133): Utility: Useful for delaying flowering time
  misc_feature (1)..(133): Utility: Useful for increasing chlorophyll and photosynthetic capacity
  misc_feature (1)..(133): Utility: Useful for making plants that grow better in shade
  misc_feature (1)..(133): Utility: Useful for making plants with enhanced abiotic stress tolerance
  misc_feature (1)..(133): Utility: Useful for making plants with increased biomass
  misc_feature (1)..(133): Utility: Useful for making plants with increased biomass and foliage
  misc_feature (1)..(133): Utility: Useful for making smaller plants
  misc_feature (1)..(133): Utility: Useful for modifying plant architecture, ie amount of branching
MDQGGRSSGSGGGGAEQGKYRGVRRRPWGKYAAEIRDSRKHGERVWLGTFDTAEDAARAYDRAAYSMRGKAAILNFPHEYNMGTGSSSTAANSSSSSQQVFEFEYLDDSVLDELLEYGENYNKTHNINMGKRQ

SEQ ID NO: 6156 - protein, 131 aa, Glycine max
  misc_feature (1)..(131): useful for making plants with modified plant phenotypes as described in USSN 12/139,269
  misc_feature (1)..(131): Public GI no. 48479320
  misc_feature (1)..(131): Utility: Useful for delaying flowering time
  misc_feature (1)..(131): Utility: Useful for increasing chlorophyll and photosynthetic capacity
  misc_feature (1)..(131): Utility: Useful for making plants that grow better in shade
  misc_feature (1)..(131): Utility: Useful for making plants with enhanced abiotic stress tolerance
  misc_feature (1)..(131): Utility: Useful for making plants with increased biomass
  misc_feature (1)..(131): Utility: Useful for making plants with increased biomass and foliage
  misc_feature (1)..(131): Utility: Useful for making smaller plants
  misc_feature (1)..(131): Utility: Useful for modifying plant architecture, ie amount of branching
MDQGGRGVGAEHGKYRGVRRRPWGKYAAEIRDSRKHGERVWLGTFDTAEEAARAYDQAAYSMRGQAAILNFPHEYNMGSGGSSSTAMAGSSSSSASASSSSRQVFEFEYLDDSVLEELLEEGEKPNKGKKK

SEQ ID NO: 6157 - protein, 128 aa, Glycine max
  misc_feature (1)..(128): useful for making plants with modified plant phenotypes as described in USSN 12/139,269
  misc_feature (1)..(128): Public GI no. 48479286
  misc_feature (1)..(128): Utility: Useful for delaying flowering time
  misc_feature (1)..(128): Utility: Useful for increasing chlorophyll and photosynthetic capacity
  misc_feature (1)..(128): Utility: Useful for making plants that grow better in shade
  misc_feature (1)..(128): Utility: Useful for making plants with enhanced abiotic stress tolerance
  misc_feature (1)..(128): Utility: Useful for making plants with increased biomass
  misc_feature (1)..(128): Utility: Useful for making plants with increased biomass and foliage
  misc_feature (1)..(128): Utility: Useful for making smaller plants
  misc_feature (1)..(128): Utility: Useful for modifying plant architecture, ie amount of branching
MKYRGVRKRPWGKYAAEIRDSARHGARVWLGTFNTAEDAARAYDRAAFGMRGQRAILNFPHEYQMMKDGPNGSHENAVASSSSGYRGGGGGDDGREVIEFEYLDDSLLEELLDYGERSNQDNCNDANR

SEQ ID NO: 6158 - protein, 139 aa, Glycine max
  misc_feature (1)..(139): useful for making plants with modified plant phenotypes as described in USSN 12/139,269
  misc_feature (1)..(139): Public GI no. 62632035
  misc_feature (1)..(139): Utility: Useful for delaying flowering time
  misc_feature (1)..(139): Utility: Useful for increasing chlorophyll and photosynthetic capacity
  misc_feature (1)..(139): Utility: Useful for making plants that grow better in shade
  misc_feature (1)..(139): Utility: Useful for making plants with enhanced abiotic stress tolerance
  misc_feature (1)..(139): Utility: Useful for making plants with increased biomass
  misc_feature (1)..(139): Utility: Useful for making plants with increased biomass and foliage
  misc_feature (1)..(139): Utility: Useful for making smaller plants
  misc_feature (1)..(139): Utility: Useful for modifying plant architecture, ie amount of branching
MERIESYNTNEMKYRGVRKRPWGKYAAEIRDSARHGARVWLGTFNTAEDAARAYDRAAFGMRGQRAILNFPHEYQMMKDGPNGSHENAVASSSSGYRGGGGGDDGREVIEFEYLDDSLLEELLDYGERSNQDNCNDANR

SEQ ID NO: 6159 - protein, 131 aa, Glycine max
  misc_feature (1)..(131): useful for making plants with modified plant phenotypes as described in USSN 12/139,269
  misc_feature (1)..(131): Public GI no. 8843894
  misc_feature (1)..(131): Utility: Useful for delaying flowering time
  misc_feature (1)..(131): Utility: Useful for increasing chlorophyll and photosynthetic capacity
  misc_feature (1)..(131): Utility: Useful for making plants that grow better in shade
  misc_feature (1)..(131): Utility: Useful for making plants with enhanced abiotic stress tolerance
  misc_feature (1)..(131): Utility: Useful for making plants with increased biomass
  misc_feature (1)..(131): Utility: Useful for making plants with increased biomass and foliage
  misc_feature (1)..(131): Utility: Useful for making smaller plants
  misc_feature (1)..(131): Utility: Useful for modifying plant architecture, ie amount of branching
MDQGGRGVGAEHGKYRGVRRRPWGKYAAEIRDSRKHGERVWLGTFDTAEEAARAYDQAAYSMRGQAAILNFPHEYNMGSGVSSSTAMAGSSSASASASSSSRQVFEFEYLDDSVLEELLEEGEKPNKGKKK

SEQ ID NO: 6160 - protein, 124 aa, Glycine max
  misc_feature (1)..(124): useful for making plants with modified plant phenotypes as described in USSN 12/139,269
  misc_feature (1)..(124): Public GI no. 31432356
  misc_feature (1)..(124): Utility: Useful for delaying flowering time
  misc_feature (1)..(124): Utility: Useful for increasing chlorophyll and photosynthetic capacity
  misc_feature (1)..(124): Utility: Useful for making plants that grow better in shade
  misc_feature (1)..(124): Utility: Useful for making plants with enhanced abiotic stress tolerance
  misc_feature (1)..(124): Utility: Useful for making plants with increased biomass
  misc_feature (1)..(124): Utility: Useful for making plants with increased biomass and foliage
  misc_feature (1)..(124): Utility: Useful for making smaller plants
  misc_feature (1)..(124): Utility: Useful for modifying plant architecture, ie amount of branching
MEDNRSKDTATKYRGVRRRPWGKFAAEIRDPERGGARVWLGTFDTAEEAARAYDRAAYAQRGAAAVLNFPAAAAAGRGGGAGGAASGSSSSSSAQRGRGDKIEFEYLDDKVLDDLLDDEKYRGK

SEQ ID NO: 6161 - protein, 136 aa, Glycine max
  misc_feature (1)..(136): useful for making plants with modified plant phenotypes as described in USSN 12/139,269
  misc_feature (1)..(136): Public GI no. 50948573
  misc_feature (1)..(136): Utility: Useful for delaying flowering time
  misc_feature (1)..(136): Utility: Useful for increasing chlorophyll and photosynthetic capacity
  misc_feature (1)..(136): Utility: Useful for making plants that grow better in shade
  misc_feature (1)..(136): Utility: Useful for making plants with enhanced abiotic stress tolerance
  misc_feature (1)..(136): Utility: Useful for making plants with increased biomass
  misc_feature (1)..(136): Utility: Useful for making plants with increased biomass and foliage
  misc_feature (1)..(136): Utility: Useful for making smaller plants
  misc_feature (1)..(136): Utility: Useful for modifying plant architecture, ie amount of branching
MDGDGGGGWDDQGNGGGETTKYRGVRRRPSGKFAAEIRDSSRQSVRVWLGTFDTAEEAARAYDRAAYAMRGHLAVLNFPAEARNYVRGSGSSSSSRQHQQRQVIELECLDDQVLQEMLKGGDDQYRSAAGSKRNNY

SEQ ID NO: 6162 - protein, 139 aa, Glycine max
  misc_feature (1)..(139): useful for making plants with modified plant phenotypes as described in USSN 12/139,269
  misc_feature (1)..(139): Public GI no. 34221729
  misc_feature (1)..(139): Utility: Useful for delaying flowering time
  misc_feature (1)..(139): Utility: Useful for increasing chlorophyll and photosynthetic capacity
  misc_feature (1)..(139): Utility: Useful for making plants that grow better in shade
  misc_feature (1)..(139): Utility: Useful for making plants with enhanced abiotic stress tolerance
  misc_feature (1)..(139): Utility: Useful for making plants with increased biomass
  misc_feature (1)..(139): Utility: Useful for making plants with increased biomass and foliage
  misc_feature (1)..(139): Utility: Useful for making smaller plants
  misc_feature (1)..(139): Utility: Useful for modifying plant architecture, ie amount of branching
MESSNRSSNNQSQDDKQARFRGVRRRPWGKFAAEIRDPSRNGARLWLGTFETAEEAARAYDRAAFNLRGHLAILNFPNEYYPRMDDYSLRPPYASSSSSSSSGSTSTNVSRQNQREVFEFEYLDDKVLEELLDSEERKR

SEQ ID NO: 6163 - protein, 128 aa, Glycine max
  misc_feature (1)..(128): useful for making plants with modified plant phenotypes as described in USSN 12/139,269
  misc_feature (1)..(128): Public GI no. 50921987
  misc_feature (1)..(128): Utility: Useful for delaying flowering time
  misc_feature (1)..(128): Utility: Useful for increasing chlorophyll and photosynthetic capacity
  misc_feature (1)..(128): Utility: Useful for making plants that grow better in shade
  misc_feature (1)..(128): Utility: Useful for making plants with enhanced abiotic stress tolerance
  misc_feature (1)..(128): Utility: Useful for making plants with increased biomass
  misc_feature (1)..(128): Utility: Useful for making plants with increased biomass and foliage
  misc_feature (1)..(128): Utility: Useful for making smaller plants
  misc_feature (1)..(128): Utility: Useful for modifying plant architecture, ie amount of branching
MEDDKKEAASKYRGVRRRPWGKFAAEIRDPERGGSRVWLGTFDTAEEAARAYDRAAFAMKGAMAVLNFPGRTSSTGSSSSSSSTPPAPVTTSRHCADTTEKVELVYLDDKVLDELLAEDYSYRNNNNY

SEQ ID NO: 6164 - protein, 131 aa, Glycine max
  misc_feature (1)..(131): useful for making plants with modified plant phenotypes as described in USSN 12/139,269
  misc_feature (1)..(131): Public GI no. 52076099
  misc_feature (1)..(131): Utility: Useful for delaying flowering time
  misc_feature (1)..(131): Utility: Useful for increasing chlorophyll and photosynthetic capacity
  misc_feature (1)..(131): Utility: Useful for making plants that grow better in shade
  misc_feature (1)..(131): Utility: Useful for making plants with enhanced abiotic stress tolerance
  misc_feature (1)..(131): Utility: Useful for making plants with increased biomass
  misc_feature (1)..(131): Utility: Useful for making plants with increased biomass and foliage
  misc_feature (1)..(131): Utility: Useful for making smaller plants
  misc_feature (1)..(131): Utility: Useful for modifying plant architecture, ie amount of branching
MDHHHQQQQQEGELVAKYRGVRRRPWGKFAAEIRDSSRHGVRVWLGTFDTAEEAARAYDRSAYSMRGANAVLNFPADAHIYARQLHNNNAAAGSSSSSSAAAAAARPPPIEFEYLDDHVLQEMLRDHTTNK

SEQ ID NO: 6165 - DNA, 505 bp, Glycine max
  misc_feature (1)..(505): useful for making plants with modified plant phenotypes as described in USSN 12/139,269
  misc_feature (1)..(505): Ceres CLONE ID no. 657337
  misc_feature (1)..(505): Also known as  Ceres CDNA ID no. 23489477
atcacgcttatttcaaatcccttcctctttctctttctctcattcccccactaacctacctgtaccatcacaaaatcctcaattccccttcctccactctttttcctcttactgaagacaaacaacacacacaaagacacagaacaacaacgtcgaaaaatgtcgacaaaccactacaccatggaccttcccgaaccaacactctggtggccacacccacaccaacaacaactaaccttaatagatccagaccctctccctctgaacctcaacaacgacgacaacgacaatggcgacgacaacgacaacgacgaaaaccaaacagttacaacaaccacaacaggaggagaagaagaaataataaacaataaagaaccgatgttcgagaagccgctaaccccgagcgacgtggggaagctgaaccgcctcgtaatcccgaagcagcacgctgagaagtactttccactgagtggtggtgactcgggcagtagcgagtgcaaggggc

SEQ ID NO: 6166 - protein, 122 aa, Glycine max
  misc_feature (1)..(122): useful for making plants with modified plant phenotypes as described in USSN 12/139,269
  misc_feature (1)..(122): Utility: Useful for delaying flowering time
  misc_feature (1)..(122): Utility: Useful for increasing chlorophyll and photosynthetic capacity
  misc_feature (1)..(122): Utility: Useful for making ornamental plants with modified leaves
  misc_feature (1)..(122): Utility: Useful for making plants with increased biomass and foliage
  misc_feature (1)..(122): Utility: Useful for making smaller plants
HAYFKSLPLSLSLIPPLTYLYHHKILNSPSSTLFPLTEDKQHTQRHRTTTSKNVDKPLHHGPSRTNTLVATPTPTTTNLNRSRPSPSEPQQRRQRQWRRQRQRRKPNSYNNHNRRRRRNNKQ

SEQ ID NO: 6167 - DNA, 1338 bp, Glycine max
  misc_feature (1)..(1338): useful for making plants with modified plant phenotypes as described in USSN 12/139,269
  misc_feature (1)..(1338): Ceres CLONE ID no. 660003
  misc_feature (1)..(1338): Also known as  Ceres CDNA ID no. 23704291
gtcataactttgctagatccatcaaagaagcagtgattcccccagcttccacatcaaatgaagccataatcatcatcatcatcaccacgcctcttctttctctttctccctaccattcacaatgtcatcgatacaccactactcaccggaaacaacactatactggaccagcgaccaccagcaacaacaacaacaacaacaacaacaacaacaacaagctgccacgtggcttagtaattcccacactccccgtttcaacctgaacgaagacgacgacgaggaagacgacgttgtcgtttcggacaaggctactaataatttggcgcaagaacaggagaaagaagcgatgttcgagaagccgttgacgccgagcgacgtcgggaagctgaaccggctcgtgatcccgaaacagcacgcggagaagtacttccctcttgactcgtccggcggtgactcggcggcggcgaaagggctcttgctgagtttcgaggacgagtcggggaagtgctggcgcttccgttactcttattggaacagtagccagagttacgttttgaccaaaggctggagccgttacgtcaaagacaaacgcctccacgcaggcgacgtcgttttgttccacagacaccgcgcccaccctcaacgcttcttcatctcctgcacccgccaccaacccaaccccaaccctcccgcgcacgttagcatcagatcctcctcctactctgcgctcccagcttatcctacgcaccatcatcatcacctccccttcccataccaacctcactctcttcacgcaccaggtggagggtcccaaggacagaacgaaacgacaccaggagggaacagttcaagtggcagggtgctgaggctgtttggggtgaacatggaatgccaacctgataatgataatgattcccaaaactccacacatgaatgctcctacacccacttataccaccatcaaacctcttcttatccttcttcaaaccctcaccatcacatgctacctcaacaaccataatagaaattagatatatatgcccccctctttattagattctcccccgttttttttttttcatttccagcttcagggttgaagtatgcccttaaattaattttagtcaatgaccgtgtcgttaacatgaacccgtgaaaggaacccttcttttattattagtatatttaggttgacgttgaagattatagaggatctttcttgtcttgaattagggagatgcatgcaaatggaaatgccttgtttattcgttttatcggatcttcttgttccctgtcactcgagcatattaattatcgactaagctgtgaatgcatgcc

SEQ ID NO: 6168 - protein, 299 aa, Glycine max
  misc_feature (1)..(299): useful for making plants with modified plant phenotypes as described in USSN 12/139,269
  misc_feature (76)..(181): Pfam Name: B3; Pfam Description: B3 DNA binding domain
  misc_feature (1)..(299): Utility: Useful for delaying flowering time
  misc_feature (1)..(299): Utility: Useful for increasing chlorophyll and photosynthetic capacity
  misc_feature (1)..(299): Utility: Useful for making larger plants
  misc_feature (1)..(299): Utility: Useful for making ornamental plants with modified leaves
  misc_feature (1)..(299): Utility: Useful for making plants with increased biomass and foliage
  misc_feature (1)..(299): Utility: Useful for making smaller plants
  misc_feature (239)..(239): Xaa is any aa, unknown or other
MSSIHHYSPETTLYWTSDHQQQQQQQQQQQQQAATWLSNSHTPRFNLNEDDDEEDDVVVSDKATNNLAQEQEKEAMFEKPLTPSDVGKLNRLVIPKQHAEKYFPLDSSGGDSAAAKGLLLSFEDESGKCWRFRYSYWNSSQSYVLTKGWSRYVKDKRLHAGDVVLFHRHRAHPQRFFISCTRHQPNPNPPAHVSIRSSSYSALPAYPTHHHHHLPFPYQPHSLHAPGGGSQGQNETTPXGNSSSGRVLRLFGVNMECQPDNDNDSQNSTHECSYTHLYHHQTSSYPSSNPHHHMLPQQP

SEQ ID NO: 6169 - protein, 244 aa, Glycine max
  misc_feature (1)..(244): useful for making plants with modified plant phenotypes as described in USSN 12/139,269
  misc_feature (1)..(244): Public GI no. 26450255
  misc_feature (1)..(244): Utility: Useful for delaying flowering time
  misc_feature (1)..(244): Utility: Useful for increasing chlorophyll and photosynthetic capacity
  misc_feature (1)..(244): Utility: Useful for making larger plants
  misc_feature (1)..(244): Utility: Useful for making ornamental plants with modified leaves
  misc_feature (1)..(244): Utility: Useful for making plants with increased biomass and foliage
  misc_feature (1)..(244): Utility: Useful for making smaller plants
MSINQYSSDFHYHSLMWQQQQQQQQHQNDVVEEKEALFEKPLTPSDVGKLNRLVIPKQHAERYFPLAAAAADAVEKGLLLCFEDEEGKPWRFRYSYWNSSQSYVLTKGWSRYVKEKHLDAGDVVLFHRHRSDGGRFFIGWRRRGDSSSSSDSYRHVQSNASLQYYPHAGAQAVESQRGNSKTLRLFGVNMECQLDSDWSEPSTPDGSNTYTTNHDQFHFYPQQQHYPPPYYMDISFTGDMNRTS

SEQ ID NO: 6170 - protein, 279 aa, Triticum aestivum
  misc_feature (1)..(279): useful for making plants with modified plant phenotypes as described in USSN 12/139,269
  misc_feature (1)..(279): Ceres CLONE ID no. 763852
  misc_feature (1)..(279): Utility: Useful for delaying flowering time
  misc_feature (1)..(279): Utility: Useful for increasing chlorophyll and photosynthetic capacity
  misc_feature (1)..(279): Utility: Useful for making larger plants
  misc_feature (1)..(279): Utility: Useful for making ornamental plants with modified leaves
  misc_feature (1)..(279): Utility: Useful for making plants with increased biomass and foliage
  misc_feature (1)..(279): Utility: Useful for making smaller plants
MAMNPLSQEHPNAWPWGVAMYTNLHYQQYHYEKEHLFEKALTPSDVGKLNRLVIPKQHAERCFPLGGDSGEKGLLLSFDDEAGKPWRFRYSYWTSSQSYVLTKGWSRYVKEKHLEAGDVVHFERVRGLGTGDRLFIGCRRRGDVSAPTAVAPPPAVHVVPASGQSPREQQQHQQPWSPMCYSTSTSYPTSPATSHAYRRSAEHDHSDMHHAGESQWDADTRSCSPASAPTRRLRLFGVNLDCAPEPEAEAVPATPAMYGYVHQSPYAAVSPVPSNWGSS

SEQ ID NO: 6171 - DNA, 1040 bp, Glycine max
  misc_feature (1)..(1040): useful for making plants with modified plant phenotypes as described in USSN 12/139,269
  misc_feature (1)..(1040): Ceres CLONE ID no. 664365
  misc_feature (1)..(1040): Also known as  Ceres CDNA ID no. 23401946
aataaaaacagagtaactctgttatactcttctcgagttccctccaaacacccaacactttgaatggattgttcctccgttctccactcatcaaactcctcattcttccccttcaacgaaaacgaccccgaagagatgctcctctacggcatgatcacgtcataccaagaaaaagtgatcatcaaagaagaggaagtgaactcagaggaaaacaacaacaagaataagaaaaacaacaacaagagcagcttccgcggcgtgcggagtcgcccgtgggggaagttcgcggcggagataagggactccacgcggcacggcgtgagggtgtggcttgggacattcgacagcgccgaggccgcggcgctggcctatgaccaagccgcgttctccatgaggggctccgccgcggtgctcaacttccccgtggagaaggtgaaggagtcattaagagacatgaattgcactctctctcagcttgatgggtcttctcccgtcgtggccttgaagaggagacactccttaggacgcaaaatggctgctaagaagaagaaggtggaagagactcatggtgatgttcggttagagaatgtggttgtgttggaagacctaggggctgagtatttggaacacttgttgatgatgtcctctcatgatactactagttgttcttggtgaatctaattatgtacaagtagaaccattgtttaatctttcatgagttgcaacaatttctttttcctacatgtttttttctttaaaagcaattctgtttgaatcttgatttatcatgttgcagaaaattaacttgagctattaattgtttagttaatatatcctatgtacttttttcagtgaccatggtcattatggtcattgaatttttctttataggatcttagagtttaaagcttggataatttgtaccgagttatcttggtggcacccatctcctatgttcttttgttcttgtattttatcattcaacatttattttggtggaaagaacatttgtcataatgtacgttactgatgttagaatg

SEQ ID NO: 6172 - protein, 203 aa, Glycine max
  misc_feature (1)..(203): useful for making plants with modified plant phenotypes as described in USSN 12/139,269
  misc_feature (61)..(125): Pfam Name: AP2; Pfam Description: AP2 domain
  misc_feature (1)..(203): Utility: Useful for delaying flowering time
  misc_feature (1)..(203): Utility: Useful for increasing chlorophyll and photosynthetic capacity
  misc_feature (1)..(203): Utility: Useful for making plants with enhanced abiotic stress tolerance
  misc_feature (1)..(203): Utility: Useful for making plants with increased biomass and foliage
  misc_feature (51)..(51): Xaa is any aa, unknown or other
  misc_feature (57)..(57): Xaa is any aa, unknown or other
  misc_feature (58)..(58): Xaa is any aa, unknown or other
MDCSSVLHSSNSSFFPFNENDPEEMLLYGMITSYQEKVIIKEEEVNSEENXNKNKKXXNKSSFRGVRSRPWGKFAAEIRDSTRHGVRVWLGTFDSAEAAALAYDQAAFSMRGSAAVLNFPVEKVKESLRDMNCTLSQLDGSSPVVALKRRHSLGRKMAAKKKKVEETHGDVRLENVVVLEDLGAEYLEHLLMMSSHDTTSCSW

SEQ ID NO: 6173 - protein, 203 aa, Glycine max; identical to SEQ ID NO: 6172
  misc_feature (1)..(203): useful for making plants with modified plant phenotypes as described in USSN 12/139,269
  misc_feature (1)..(203): Ceres CLONE ID no. 664365
  misc_feature (1)..(203): Utility: Useful for delaying flowering time
  misc_feature (1)..(203): Utility: Useful for increasing chlorophyll and photosynthetic capacity
  misc_feature (1)..(203): Utility: Useful for making plants with enhanced abiotic stress tolerance
  misc_feature (1)..(203): Utility: Useful for making plants with increased biomass and foliage
  misc_feature (51)..(51): Xaa is any aa, unknown or other
  misc_feature (57)..(57): Xaa is any aa, unknown or other
  misc_feature (58)..(58): Xaa is any aa, unknown or other

SEQ ID NO: 6174 - protein, 240 aa, Glycine max; identical to SEQ ID NO: 5638
  misc_feature (1)..(240): useful for making plants with modified plant phenotypes as described in USSN 12/139,269
  misc_feature (1)..(240): Public GI no. 23452024
  misc_feature (1)..(240): Utility: Useful for delaying flowering time
  misc_feature (1)..(240): Utility: Useful for increasing chlorophyll and photosynthetic capacity
  misc_feature (1)..(240): Utility: Useful for making plants with enhanced abiotic stress tolerance
  misc_feature (1)..(240): Utility: Useful for making plants with increased biomass and foliage

SEQ ID NO: 6175 - protein, 166 aa, Glycine max
  misc_feature (1)..(166): useful for making plants with modified plant phenotypes as described in USSN 12/139,269
  misc_feature (1)..(166): Public GI no. 50920293
  misc_feature (1)..(166): Utility: Useful for delaying flowering time
  misc_feature (1)..(166): Utility: Useful for increasing chlorophyll and photosynthetic capacity
  misc_feature (1)..(166): Utility: Useful for making plants with enhanced abiotic stress tolerance
  misc_feature (1)..(166): Utility: Useful for making plants with increased biomass and foliage
MDAHGQEEEEEPMQVQQQQAFRGVRKRPWGKFAAEIRDSTRNGVRVWLGTFDSAEEAALAYDQAAFAMRGSAAVLNFPMEQVRRSMDMSLLQEGASPVVALKRRHSMRAAAAGRRRKSAAPAPADQEGGGGVMELEDLGPDYLEELLAASQPIDITCCTSPSHHSI

SEQ ID NO: 6176 - protein, 229 aa, Arabidopsis thaliana
  misc_feature (1)..(229): useful for making plants with modified plant phenotypes as described in USSN 12/139,269
  misc_feature (1)..(229): Ceres CLONE ID no. 21068
  misc_feature (1)..(229): Utility: Useful for delaying flowering time
  misc_feature (1)..(229): Utility: Useful for increasing chlorophyll and photosynthetic capacity
  misc_feature (1)..(229): Utility: Useful for making plants with enhanced abiotic stress tolerance
  misc_feature (1)..(229): Utility: Useful for making plants with increased biomass and foliage
QSSQETEYFFYMDPLLIQSPFSGFSPEYSIGSSPESFSSSSSNNYSLPFNENDSEEMFLYGLIEQSTQQTYIDSELQDLPIKSVSSRKSEKSYRGVRRRPWGKFAAEIRDSTRNGIRVWLGTFESAEEAALAYDQAAFSMRGSSAILNFSAERVQESLSEIKCTYEDGCSPVVALKRKHSMRRRMTNKKTKDSDFDHRSVKLDNVVVFEDLGEQYLEELLGSSENSGTW

SEQ ID NO: 6177 - protein, 218 aa, Arabidopsis thaliana; identical to SEQ ID NO: 5636
  misc_feature (1)..(218): useful for making plants with modified plant phenotypes as described in USSN 12/139,269
  misc_feature (1)..(218): Public GI no. 21554205
  misc_feature (1)..(218): Utility: Useful for delaying flowering time
  misc_feature (1)..(218): Utility: Useful for increasing chlorophyll and photosynthetic capacity
  misc_feature (1)..(218): Utility: Useful for making plants with enhanced abiotic stress tolerance
  misc_feature (1)..(218): Utility: Useful for making plants with increased biomass and foliage

SEQ ID NO: 6178 - protein, 218 aa, Arabidopsis thaliana
  misc_feature (1)..(218): useful for making plants with modified plant phenotypes as described in USSN 12/139,269
  misc_feature (1)..(218): Public GI no. 57012702
  misc_feature (1)..(218): Utility: Useful for delaying flowering time
  misc_feature (1)..(218): Utility: Useful for increasing chlorophyll and photosynthetic capacity
  misc_feature (1)..(218): Utility: Useful for making plants with enhanced abiotic stress tolerance
  misc_feature (1)..(218): Utility: Useful for making plants with increased biomass and foliage
MDPFLIQSPFSGFSPEYSIGSSPDSFSSSSSNNYSLPFNENDSEEMFLYGLIEQSTQQTYIDSDSQDLPIKSVSSRKSEKSYRGVRRRPWGKFAAEIRDSTRNGIRVWLGTFESAEEAALAYDQAAFSMRGSSAILNFSAERVQESLSEIKYTYEDGCSPVVALKRKHSMRRRMTNKKTKDSDFDHRSVKLDNVVVFEDLGEQYLEELLGSSENSGTW

SEQ ID NO: 6179 - DNA, 541 bp, Glycine max; identical to SEQ ID NO: 5250
  misc_feature (1)..(541): useful for making plants with modified plant phenotypes as described in USSN 12/139,269
  misc_feature (1)..(541): Ceres CLONE ID no. 679923
  misc_feature (1)..(541): Also known as  Ceres CDNA ID no. 23702778

SEQ ID NO: 6180 - protein, 123 aa, Glycine max
  misc_feature (1)..(123): useful for making plants with modified plant phenotypes as described in USSN 12/139,269
  misc_feature (1)..(63): Pfam Name: AP2; Pfam Description: AP2 domain
  misc_feature (1)..(123): Utility: Useful for delaying flowering time
  misc_feature (1)..(123): Utility: Useful for delaying senescence
  misc_feature (1)..(123): Utility: Useful for making larger plants
  misc_feature (1)..(123): Utility: Useful for making ornamental plants with modified flowers
  misc_feature (1)..(123): Utility: Useful for making ornamental plants with modified leaves
  misc_feature (1)..(123): Utility: Useful for making plants sterile and for genetic confinement
  misc_feature (1)..(123): Utility: Useful for making plants with altered leaf shape eg curled leaves
  misc_feature (1)..(123): Utility: Useful for making plants with enhanced plant architecture
  misc_feature (1)..(123): Utility: Useful for making plants with increased biomass and foliage
  misc_feature (1)..(123): Utility: Useful for making smaller plants
  misc_feature (1)..(123): Utility: Useful for making stronger plants
  misc_feature (1)..(123): Utility: Useful for modifying plant structure, ie increased branching
MYLGVRKRPWGRYAAEIRNPYTKERHWLGTFDTAEEAAIAYDLSSIKICGINARTNFHYPFVSLPPLPMSSLPPPPPPPTPELDPSVEVCLEMMNAASYDGDDESLVIASILQSFSNSGNCSF

SEQ ID NO: 6181 - DNA, 1026 bp, Glycine max
  misc_feature (1)..(1026): useful for making plants with modified plant phenotypes as described in USSN 12/139,269
  misc_feature (1)..(1026): Ceres CLONE ID no. 708342
  misc_feature (1)..(1026): Also known as  Ceres CDNA ID no. 23706745
aaaaaacgcagccaaaacagcaacaaacgacagagattcttcctcaacacaatcgaaaaaaaaaaaagcttccgattctaaaaccagaacaacaaaaaagtaaaacacacacgtcattttaaaacatttcatttttttggttatttatttaaagagcgagtgttgtaacaaatggtgaagccgaagagcgtggagaaacccgcagaggaacaacaacaacgaagtgtttcatcgtacagaggagtacggaagaggaagtgggggaagtacgtgtcggaaattaggttacccaacagccgtcaaaggatttggttgggttcctatgacagcgccgagaaggcggcacgcgcgttcgacgctgccatgttctgcttacgtggcagcggcgccaaatttaatttcccgagtgacccacccaacatcgccggcggggggaacatgacctcctcccagattcagatcgcggcggcgcgtttcgccaattcggagccccgaaatgagcgttcggatcaacccgtggagtctttaacttcggatgaggaaacggcatcgtttccggtcatttcggatacggatacatcatctcctcctctctcagacgtgacgttccaaaacgacgccgaattagtgactgggtcgttccctgatatgttttcggatttcgggtcgggcgattttgtgcccgatttctccgattttccgagcttcgacgatttcagccgggacttcttcttgcatgaacttccgggtttcaatttcggagaagagaacttggatggattgataattcaggactcgttcttgtggaatttctaagcgggtcagggttcggataattttattatatccgaacccgatatcagaatccggatcggatccgggtttgggttgggtcaaattttgcgtgccaagccctccatgtgttagtagttagtgatgattatagttttttttttaacgtaccaagtagtcaaatgtttcgattttttgggatgcgaatcataattcatttatttgtcatgactc

SEQ ID NO: 6182 - protein, 214 aa, Glycine max
  misc_feature (1)..(214): useful for making plants with modified plant phenotypes as described in USSN 12/139,269
  misc_feature (20)..(83): Pfam Name: AP2; Pfam Description: AP2 domain
  misc_feature (1)..(214): Utility: Useful for delaying flowering time
  misc_feature (1)..(214): Utility: Useful for making plants sterile and for genetic confinement
  misc_feature (1)..(214): Utility: Useful for making plants with increased biomass and foliage
  misc_feature (1)..(214): Utility: Useful for making smaller plants
MVKPKSVEKPAEEQQQRSVSSYRGVRKRKWGKYVSEIRLPNSRQRIWLGSYDSAEKAARAFDAAMFCLRGSGAKFNFPSDPPNIAGGGNMTSSQIQIAAARFANSEPRNERSDQPVESLTSDEETASFPVISDTDTSSPPLSDVTFQNDAELVTGSFPDMFSDFGSGDFVPDFSDFPSFDDFSRDFFLHELPGFNFGEENLDGLIIQDSFLWNF

SEQ ID NO: 6183 - protein, 185 aa, Glycine max; identical to SEQ ID NO: 6146
  misc_feature (1)..(185): useful for making plants with modified plant phenotypes as described in USSN 12/139,269
  misc_feature (1)..(185): Public GI no. 29893536
  misc_feature (1)..(185): Utility: Useful for delaying flowering time
  misc_feature (1)..(185): Utility: Useful for making plants sterile and for genetic confinement
  misc_feature (1)..(185): Utility: Useful for making plants with increased biomass and foliage
  misc_feature (1)..(185): Utility: Useful for making smaller plants

SEQ ID NO: 6184 - protein, 178 aa, Glycine max
  misc_feature (1)..(178): useful for making plants with modified plant phenotypes as described in USSN 12/139,269
  misc_feature (1)..(178): Public GI no. 12083252
  misc_feature (1)..(178): Utility: Useful for delaying flowering time
  misc_feature (1)..(178): Utility: Useful for making plants sterile and for genetic confinement
  misc_feature (1)..(178): Utility: Useful for making plants with increased biomass and foliage
  misc_feature (1)..(178): Utility: Useful for making smaller plants
MQSKYKGVRKRKWGKWVSEIRLPNSRERIWLGSYDTPEKAARAFDAALYCLRGNNAKFNFPDNPPVISGGRNLSRSEIREAAARFANSAEDDSSGGAGYEIRQESASTSMDVDSEFLSMLPTVGSGNFASEFGLFPGFDDFSDEYSGDRFREQLSPTQDYYQLGEETYADGSMFLWNF

SEQ ID NO: 6185 - protein, 187 aa, Parthenium argentatum
  misc_feature (1)..(187): useful for making plants with modified plant phenotypes as described in USSN 12/139,269
  misc_feature (1)..(187): Ceres CLONE ID no. 1609832
  misc_feature (1)..(187): Utility: Useful for delaying flowering time
  misc_feature (1)..(187): Utility: Useful for making plants sterile and for genetic confinement
  misc_feature (1)..(187): Utility: Useful for making plants with increased biomass and foliage
  misc_feature (1)..(187): Utility: Useful for making smaller plants
MMKPKSSEGSSSSTHEPKYKGVRLRKWGKWVSEIRLPNSRERIWLGSYDSPEKAARAFDAAAFCLRGHAAKFNFPDQPPNIPGGRSLSSAQIQDAAARYANSVPDETVIPMEDSTSSSIMLNDDSNYNNNSSSSNNNNNVTDYDIFPGFDDYFMQPPPMVSPQFADYDEGNSSDGDISQGPSFLWNY

SEQ ID NO: 6186 - protein, 243 aa, Parthenium argentatum
  misc_feature (1)..(243): useful for making plants with modified plant phenotypes as described in USSN 12/139,269
  misc_feature (1)..(243): Public GI no. 50946411
  misc_feature (1)..(243): Utility: Useful for delaying flowering time
  misc_feature (1)..(243): Utility: Useful for making plants sterile and for genetic confinement
  misc_feature (1)..(243): Utility: Useful for making plants with increased biomass and foliage
  misc_feature (1)..(243): Utility: Useful for making smaller plants
MDHIGISGGGEGGVVSPAQPSSPERRYKGVRLRKWGRWVSEIRMPNSRERIWLGSYESAEKAARAFDAAAVCLRGSRGAGSLNFPESPPPDVRRRFPGAALTVEQIQAEAARHANRPFPANTAAAGGSSSSYSISQRQEAAAPARSTSNDDTAMSSVPSTDGGAADYDGGDDVIDWSFMDTLPAMSSSAASTNADLVPAMDDFMYGFLHTMPPSPCEDGGEDVMIDGNCNMDQTFFSVDLWRF

SEQ ID NO: 6187 - DNA, 653 bp, Brassica napus
  misc_feature (1)..(653): useful for making plants with modified plant phenotypes as described in USSN 12/139,269
  misc_feature (1)..(653): Ceres CLONE ID no. 969750
  misc_feature (1)..(653): Also known as  Ceres CDNA ID no. 23419038
acaaacacacaacacaacaatggattacatcgacaacaccgtcgaaactcaatcaaagtacaaaggcatccgtcgccggaaatgggggaaatgggtatcggagattcgagttccgggaactcgcgaccgtctctggttaggctcattctccacggcggaaggcgcagccgtggcgcacgacgtggctttctactgtttacaccaaccaaactcgctcgaatctctcaacttccctcacttgcttcctccttccatagtttccaagacttcgccgaggtctatccagcaagctgcttctaatgccggaatggccgttgacgccggaatcgttaacagctgtgatcacgcgtccgggaactctgggaatggagatacaacgacggcgtattgtgagaatggaggtgcgttgaatatatcagtgtatgattatttggacggtcacgatcacgtttgaacttcatcttcttgttttttcgtttaaagatacagctactcaaaagaaacagtgatggagcctggtgtgtaagcaaacaaagcgttgtaaatataattatacgtttatgtttcgctgttggcccaattcaagaaacttttgttgtacgattatatatatttttattttgaatgccttcaagaggattataatgcgagtg

SEQ ID NO: 6188 - protein, 144 aa, Brassica napus
  misc_feature (1)..(144): useful for making plants with modified plant phenotypes as described in USSN 12/139,269
  misc_feature (12)..(77): Pfam Name: AP2; Pfam Description: AP2 domain
  misc_feature (1)..(144): Utility: Useful for delaying flowering time
  misc_feature (1)..(144): Utility: Useful for making larger plants
MDYIDNTVETQSKYKGIRRRKWGKWVSEIRVPGTRDRLWLGSFSTAEGAAVAHDVAFYCLHQPNSLESLNFPHLLPPSIVSKTSPRSIQQAASNAGMAVDAGIVNSCDHASGNSGNGDTTTAYCENGGALNISVYDYLDGHDHV

SEQ ID NO: 6189 - protein, 144 aa, Arabidopsis thaliana
  misc_feature (1)..(144): useful for making plants with modified plant phenotypes as described in USSN 12/139,269
  misc_feature (1)..(144): Ceres CLONE ID no. 26867
  misc_feature (1)..(144): Utility: Useful for delaying flowering time
  misc_feature (1)..(144): Utility: Useful for making larger plants
MDYRESTGESQSKYKGIRRRKWGKWVSEIRVPGTRDRLWLGSFSTAEGAAVAHDVAFFCLHQPDSLESLNFPHLLNPSLVSRTSPRSIQQAASNAGMAIDAGIVHSTSVNSGCGDTTTYYENGADQVEPLNISVYDYLGGHDHV

SEQ ID NO: 6190 - protein, 144 aa, Arabidopsis thaliana; identical to SEQ ID NO: 6189
  misc_feature (1)..(144): useful for making plants with modified plant phenotypes as described in USSN 12/139,269
  misc_feature (1)..(144): Public GI no. 21555003
  misc_feature (1)..(144): Utility: Useful for delaying flowering time
  misc_feature (1)..(144): Utility: Useful for making larger plants

SEQ ID NO: 6191 - protein, 179 aa, Zea mays
  misc_feature (1)..(179): useful for making plants with modified plant phenotypes as described in USSN 12/139,269
  misc_feature (1)..(179): Ceres CLONE ID no. 1469452
  misc_feature (1)..(179): Utility: Useful for delaying flowering time
  misc_feature (1)..(179): Utility: Useful for making larger plants
MRRAEPVGEQADAERRMSGYKGVRRRRWGKWVSEIRVPGSRERLWLGSYATPEAAAVAHDTAVYFLRGGGGGPGDVAALNFPERAAAAYGAGGRLSPRSVQRVASDAGMAADAQLVAAREDTRAHRTGIGGGASARPRDRDAGDACAGRAHNASLHSTGAGREQPVSGEISVDDMDILL

SEQ ID NO: 6192 - DNA, 867 bp, Arabidopsis thaliana
  misc_feature (1)..(867): useful for making plants with modified plant phenotypes as described in USSN 12/139,269
  misc_feature (1)..(867): Ceres CLONE ID no. 1001432
  misc_feature (1)..(867): Also known as  Ceres CDNA ID no. 23406024
agggtttattcttcattgcttgagcttccttctcttcttcttcttcaagccgcggctgaagatccctacttctctcgacacttatagagtttcaggtccattctctgattcctgttttttcattttctaatttcctatttacgggtttttactaatcttctagtgatcctccagtcatggccgcctccgcagaaatcgacgctgagattcaacagcagcttaccaatgaggttaagctcttcaaccgttggagctttgatgacgtttcggttacggatattagtcttgtggactacattggtgttcagccatcgaagcacgcaacttttgttccccatactgctggacgatactctgtgaagaggttcagaaaggcgcagtgcccaattgttgagaggctcactaactctctcatgatgcacggaagaaacaatggtaagaagttgatggctgtcaggatcgtcaagcatgccatggagattatccacctcttgtctgacttgaacccgattcaagttatcattgatgccattgttaacagtggtccacgtgaagatgctaccaggattggatctgctggtgtggttaggaggcaggctgttgatatctctcctctaagacgtgtgaaccaagcgatcttcttgcttacaactggtgcacgtgaagctgcctttagaaacatcaagacaatcgctgagtgccttgctgatgaactcatcaatgctgcaaagggatcttccaacagctatgccatcaagaagaaagatgagattgagagagttgctaaggccaatcgttaagggatctccctttcctctaagtttgcattatatcaaagagtttttgtgttgtttccattagctttgg

SEQ ID NO: 6193 - protein, 207 aa, Arabidopsis thaliana [sequence omitted]

SEQ ID NO: 6194 - protein, 204 aa, Glycine max; identical to SEQ ID NO: 5359
  misc_feature (1)..(204): useful for making plants with modified plant phenotypes as described in USSN 12/139,269
  misc_feature (1)..(204): Ceres CLONE ID no. 533766
  misc_feature (1)..(204): Utility: Useful for delaying flowering time
  misc_feature (1)..(204): Utility: Useful for increasing chlorophyll and photosynthetic capacity
  misc_feature (1)..(204): Utility: Useful for increasing increasing anthocyanin content
  misc_feature (1)..(204): Utility: Useful for making ornamental plants with modified leaves
  misc_feature (1)..(204): Utility: Useful for making plants with altered leaf shape eg curled leaves
  misc_feature (1)..(204): Utility: Useful for making plants with increased biomass and foliage
  misc_feature (1)..(204): Utility: Useful for making smaller plants
  misc_feature (1)..(204): Utility: Useful for making stronger plants

SEQ ID NO: 6195 - protein, 204 aa, Glycine max; identical to SEQ ID NO: 5360
  misc_feature (1)..(204): useful for making plants with modified plant phenotypes as described in USSN 12/139,269
  misc_feature (1)..(204): Ceres CLONE ID no. 471212
  misc_feature (1)..(204): Utility: Useful for delaying flowering time
  misc_feature (1)..(204): Utility: Useful for increasing chlorophyll and photosynthetic capacity
  misc_feature (1)..(204): Utility: Useful for increasing increasing anthocyanin content
  misc_feature (1)..(204): Utility: Useful for making ornamental plants with modified leaves
  misc_feature (1)..(204): Utility: Useful for making plants with altered leaf shape eg curled leaves
  misc_feature (1)..(204): Utility: Useful for making plants with increased biomass and foliage
  misc_feature (1)..(204): Utility: Useful for making smaller plants
  misc_feature (1)..(204): Utility: Useful for making stronger plants

SEQ ID NO: 6196 - protein, 204 aa, Triticum aestivum; identical to SEQ ID NO: 5360
  misc_feature (1)..(204): useful for making plants with modified plant phenotypes as described in USSN 12/139,269
  misc_feature (1)..(204): Ceres CLONE ID no. 792839
  misc_feature (1)..(204): Utility: Useful for delaying flowering time
  misc_feature (1)..(204): Utility: Useful for increasing chlorophyll and photosynthetic capacity
  misc_feature (1)..(204): Utility: Useful for increasing increasing anthocyanin content
  misc_feature (1)..(204): Utility: Useful for making ornamental plants with modified leaves
  misc_feature (1)..(204): Utility: Useful for making plants with altered leaf shape eg curled leaves
  misc_feature (1)..(204): Utility: Useful for making plants with increased biomass and foliage
  misc_feature (1)..(204): Utility: Useful for making smaller plants
  misc_feature (1)..(204): Utility: Useful for making stronger plants

SEQ ID NO: 6197 - protein, 200 aa, Triticum aestivum; identical to SEQ ID NO: 5365
  misc_feature (1)..(200): useful for making plants with modified plant phenotypes as described in USSN 12/139,269
  misc_feature (1)..(200): Ceres CLONE ID no. 741488
  misc_feature (1)..(200): Utility: Useful for delaying flowering time
  misc_feature (1)..(200): Utility: Useful for increasing chlorophyll and photosynthetic capacity
  misc_feature (1)..(200): Utility: Useful for increasing increasing anthocyanin content
  misc_feature (1)..(200): Utility: Useful for making ornamental plants with modified leaves
  misc_feature (1)..(200): Utility: Useful for making plants with altered leaf shape eg curled leaves
  misc_feature (1)..(200): Utility: Useful for making plants with increased biomass and foliage
  misc_feature (1)..(200): Utility: Useful for making smaller plants
  misc_feature (1)..(200): Utility: Useful for making stronger plants

SEQ ID NO: 6198 - protein, 200 aa, Triticum aestivum; identical to SEQ ID NO: 5362
  misc_feature (1)..(200): useful for making plants with modified plant phenotypes as described in USSN 12/139,269
  misc_feature (1)..(200): Ceres CLONE ID no. 1033671
  misc_feature (1)..(200): Utility: Useful for delaying flowering time
  misc_feature (1)..(200): Utility: Useful for increasing chlorophyll and photosynthetic capacity
  misc_feature (1)..(200): Utility: Useful for increasing increasing anthocyanin content
  misc_feature (1)..(200): Utility: Useful for making ornamental plants with modified leaves
  misc_feature (1)..(200): Utility: Useful for making plants with altered leaf shape eg curled leaves
  misc_feature (1)..(200): Utility: Useful for making plants with increased biomass and foliage
  misc_feature (1)..(200): Utility: Useful for making smaller plants
  misc_feature (1)..(200): Utility: Useful for making stronger plants

SEQ ID NO: 6199 - protein, 200 aa, Triticum aestivum; identical to SEQ ID NO: 5366
  misc_feature (1)..(200): useful for making plants with modified plant phenotypes as described in USSN 12/139,269
  misc_feature (1)..(200): Public GI no. 34893994
  misc_feature (1)..(200): Utility: Useful for delaying flowering time
  misc_feature (1)..(200): Utility: Useful for increasing chlorophyll and photosynthetic capacity
  misc_feature (1)..(200): Utility: Useful for increasing increasing anthocyanin content
  misc_feature (1)..(200): Utility: Useful for making ornamental plants with modified leaves
  misc_feature (1)..(200): Utility: Useful for making plants with altered leaf shape eg curled leaves
  misc_feature (1)..(200): Utility: Useful for making plants with increased biomass and foliage
  misc_feature (1)..(200): Utility: Useful for making smaller plants
  misc_feature (1)..(200): Utility: Useful for making stronger plants

SEQ ID NO: 6200 - protein, 199 aa, Zea mays; identical to SEQ ID NO: 5364
  misc_feature (1)..(199): useful for making plants with modified plant phenotypes as described in USSN 12/139,269
  misc_feature (1)..(199): Ceres CLONE ID no. 287037
  misc_feature (1)..(199): Utility: Useful for delaying flowering time
  misc_feature (1)..(199): Utility: Useful for increasing chlorophyll and photosynthetic capacity
  misc_feature (1)..(199): Utility: Useful for increasing increasing anthocyanin content
  misc_feature (1)..(199): Utility: Useful for making ornamental plants with modified leaves
  misc_feature (1)..(199): Utility: Useful for making plants with altered leaf shape eg curled leaves
  misc_feature (1)..(199): Utility: Useful for making plants with increased biomass and foliage
  misc_feature (1)..(199): Utility: Useful for making smaller plants
  misc_feature (1)..(199): Utility: Useful for making stronger plants

SEQ ID NO: 6201 - protein, 199 aa, Zea mays; identical to SEQ ID NO: 5363
  misc_feature (1)..(199): useful for making plants with modified plant phenotypes as described in USSN 12/139,269
  misc_feature (1)..(199): Ceres CLONE ID no. 1281072
  misc_feature (1)..(199): Utility: Useful for delaying flowering time
  misc_feature (1)..(199): Utility: Useful for increasing chlorophyll and photosynthetic capacity
  misc_feature (1)..(199): Utility: Useful for increasing increasing anthocyanin content
  misc_feature (1)..(199): Utility: Useful for making ornamental plants with modified leaves
  misc_feature (1)..(199): Utility: Useful for making plants with altered leaf shape eg curled leaves
  misc_feature (1)..(199): Utility: Useful for making plants with increased biomass and foliage
  misc_feature (1)..(199): Utility: Useful for making smaller plants
  misc_feature (1)..(199): Utility: Useful for making stronger plants

SEQ ID NO: 6202 - protein, 212 aa, Zea mays; identical to SEQ ID NO: 5367
  misc_feature (1)..(212): useful for making plants with modified plant phenotypes as described in USSN 12/139,269
  misc_feature (1)..(212): Public GI no. 40748265
  misc_feature (1)..(212): Utility: Useful for delaying flowering time
  misc_feature (1)..(212): Utility: Useful for increasing chlorophyll and photosynthetic capacity
  misc_feature (1)..(212): Utility: Useful for increasing increasing anthocyanin content
  misc_feature (1)..(212): Utility: Useful for making ornamental plants with modified leaves
  misc_feature (1)..(212): Utility: Useful for making plants with altered leaf shape eg curled leaves
  misc_feature (1)..(212): Utility: Useful for making plants with increased biomass and foliage
  misc_feature (1)..(212): Utility: Useful for making smaller plants
  misc_feature (1)..(212): Utility: Useful for making stronger plants

SEQ ID NO: 6203 - DNA, 1363 bp, Arabidopsis thaliana
  misc_feature (1)..(1363): useful for making plants with modified plant phenotypes as described in USSN 12/139,269
  misc_feature (1)..(1363): Ceres CLONE ID no. 1002819
  misc_feature (1)..(1363): Also known as  Ceres CDNA ID no. 23557715
aaaatctagagaagcttgtttctagggtttcgactctcgacggccggtacgatttttcaactgcttgttctaaggaatcatgaagcctgtcttttgcggaaactttgagtatgatgctcgtgagagtgatcttgagcggcttttcagaaagtacggcaaggttgagagggttgatatgaaagctgggtttgcttttgtctatatggaagatgaaagggatgctgaagatgcaattcgagcgcttgatcgctttgaatatggtcgcacaggacgcagactccgtgttgagtggacaaagaatgaccgtggaggtgctggaagatcaggtggttcgaggagatcatcttctggcttgagaccttccaagactctgtttgtgatcaacttcgatgcacaaaacactaggactcgggacttggagaggcactttgagccgtatggtaaaattgttaatgttagaatcagaaggaattttgcattcatccaatatgaggcacaagaagatgctaccagagcactggatgctacaaattccagtaagctgatggataaggtgatctcagtggagtatgcagtgaaagatgatgattcaagaggaaatggatacagtcctgaaagacggcgtgataggtcacctgataggagaaggcgatcaccaagtccttacagaagagaaaggggaagtcctgactatggccgaggtgctagtccagtagctcacaaaagggaaaggactagtcctgattatggtcgtggaagacgcagccccagcccttacaagagagccaggcttagcccagattacaagagggatgaccgtaggagggagagagtggctagcccagagaatggagctgtaaggaaccgaagcccaagaaaaggacgtggtgaaagcaggagtcctcctccatatgagaagaggagggaaagcaggagtcctccgccatatgagaagagaagggaaagcaggagtcctcctccatatgagaagaggagggagaggtcaaggtcaaggtcgaagtcaagccctgagaatggtcaagttgagagccctgggcaaataatggaagtagaagctggaagaggatacgatggagcagacagcccgatacgcgagagcagcccctctcgttcgccgccagcagaggaatgattggagatgcagacagataattgtgttggattcacaaacaaaagatgtctctcaaagtagttgtatccgaaactgaagtcttttgctatgtcatgtagtatttagtgtgttattttgggtctttgttaagtgttttgtaaactttattatgactccattcgaaatcgcttgtcgtagtattggttaaaagattgctttttagtttggatt

SEQ ID NO: 6204 - protein, 357 aa, Arabidopsis thaliana
  misc_feature (1)..(357): useful for making plants with modified plant phenotypes as described in USSN 12/139,269
  misc_feature (98)..(162): Pfam Name: RRM_1; Pfam Description: RNA recognition motif. (a.k.a. RRM, RBD, or RNP domain)
  misc_feature (98)..(162): Pfam Name: RRM_1; Pfam Description: RNA recognition motif. (a.k.a. RRM, RBD, or RNP domain)
  misc_feature (1)..(357): Utility: Useful for delaying flowering time
  misc_feature (1)..(357): Utility: Useful for making ornamental plants with modified flowers
  misc_feature (1)..(357): Utility: Useful for making ornamental plants with modified leaves
  misc_feature (1)..(357): Utility: Useful for making plants sterile and for genetic confinement
  misc_feature (1)..(357): Utility: Useful for making plants with increased biomass and foliage
  misc_feature (1)..(357): Utility: Useful for making smaller plants
  misc_feature (1)..(357): Utility: Useful for making stronger plants
  misc_feature (1)..(357): Utility: Useful for making taller plants and plants with longer inflorescences
MKPVFCGNFEYDARESDLERLFRKYGKVERVDMKAGFAFVYMEDERDAEDAIRALDRFEYGRTGRRLRVEWTKNDRGGAGRSGGSRRSSSGLRPSKTLFVINFDAQNTRTRDLERHFEPYGKIVNVRIRRNFAFIQYEAQEDATRALDATNSSKLMDKVISVEYAVKDDDSRGNGYSPERRRDRSPDRRRRSPSPYRRERGSPDYGRGASPVAHKRERTSPDYGRGRRSPSPYKRARLSPDYKRDDRRRERVASPENGAVRNRSPRKGRGESRSPPPYEKRRESRSPPPYEKRRESRSPPPYEKRRERSRSRSKSSPENGQVESPGQIMEVEAGRGYDGADSPIRESSPSRSPPAEE

SEQ ID NO: 6205 - protein, 350 aa, Arabidopsis thaliana
  misc_feature (1)..(350): useful for making plants with modified plant phenotypes as described in USSN 12/139,269
  misc_feature (1)..(350): Ceres CLONE ID no. 113457
  misc_feature (1)..(350): Utility: Useful for delaying flowering time
  misc_feature (1)..(350): Utility: Useful for making ornamental plants with modified flowers
  misc_feature (1)..(350): Utility: Useful for making ornamental plants with modified leaves
  misc_feature (1)..(350): Utility: Useful for making plants sterile and for genetic confinement
  misc_feature (1)..(350): Utility: Useful for making plants with increased biomass and foliage
  misc_feature (1)..(350): Utility: Useful for making smaller plants
  misc_feature (1)..(350): Utility: Useful for making stronger plants
  misc_feature (1)..(350): Utility: Useful for making taller plants and plants with longer inflorescences
MKPVFCGNFEYDAREGDLERLFRKYGKVERVDMKAGFAFVYMEDERDAEDAIRALDRFEFGRKGRRLRVEWTKSERGGDKRSGGGSRRSSSSMRPSKTLFVINFDADNTRTRDLEKHFEPYGKIVNVRIRRNFAFIQYEAQEDATRALDASNNSKLMDKVISVEYAVKDDDARGNGHSPERRRDRSPERRRRSPSPYKRERGSPDYGRGASPVAAYRKERTSPDYGRRRSPSPYKKSRRGSPEYGRDRRGNDSPRRRERVASPTKYSRSPNNKRERMSPNHSPFKKESPRNGVGEVESPIERRERSRSSPENGQVESPGSIGRRDSDGGYDGAESPMQKSRSPRSPPADE

SEQ ID NO: 6206 - DNA, 396 bp, Arabidopsis thaliana
  misc_feature (1)..(396): useful for making plants with modified plant phenotypes as described in USSN 12/139,269
  misc_feature (1)..(396): Ceres CLONE ID no. 1006934
  misc_feature (1)..(396): Also known as  Ceres CDNA ID no. 24374760
agaaacattttctttcaaaagagagattacaacaaccatgtgtggaatcttcgcgtatctgaattttcacgcgaacaaagagagacgatacattctcgatgttctcttcaatggtcttcgtcgtcttgaatacagaggctacgattctgctggaatcgccattgataattcttctccttcttcttctcctctcgtgtttcgtcaagcaggaaacattgaatcacttgttaattccgttaacgaagagattacgaatacggatttgaatctagacgaagttttctactttcatgctggaattgcacatacgaggtgggctactcatggtgagccagctccaaggaatagtcatcctcaatcttctggtcctggagatgattttttggtggttcataa

SEQ ID NO: 6207 - protein, 119 aa, Arabidopsis thaliana
  misc_feature (1)..(119): useful for making plants with modified plant phenotypes as described in USSN 12/139,269
  misc_feature (2)..(119): Pfam Name: GATase_2; Pfam Description: Glutamine amidotransferases class-II
  misc_feature (1)..(119): Utility: Useful for delaying flowering time
  misc_feature (1)..(119): Utility: Useful for increasing chlorophyll and photosynthetic capacity
  misc_feature (1)..(119): Utility: Useful for making ornamental plants with modified leaves
  misc_feature (1)..(119): Utility: Useful for making plants with increased biomass and foliage
  misc_feature (1)..(119): Utility: Useful for making smaller plants
MCGIFAYLNFHANKERRYILDVLFNGLRRLEYRGYDSAGIAIDNSSPSSSPLVFRQAGNIESLVNSVNEEITNTDLNLDEVFYFHAGIAHTRWATHGEPAPRNSHPQSSGPGDDFLVVH

SEQ ID NO: 6208 - DNA, 683 bp, Arabidopsis thaliana
  misc_feature (1)..(683): useful for making plants with modified plant phenotypes as described in USSN 12/139,269
  misc_feature (1)..(683): Ceres CLONE ID no. 1007549
  misc_feature (1)..(683): Also known as  Ceres CDNA ID no. 23416657
aacaaggagcaaagagttcatagcaaagcaaagcttcaaaacagagtaaacgcaaagagtagcaatcacaagaggaagtgaaacgatgtctctaattccaagcatcttcggaggaagaagaacaaacgttttcgatccgttctcgctggatgttttcgatccgttcgaaggtttcttgacgccgtcaggattggcaaacgcacccgctaaggatgtggcagcgttcacaaacgctaaagtggattggagggagacacctgaggcgcacgtgttcaaggcggatttaccgggactgaggaaggaagaggtgaaagtggaggttgaggatggcaacatacttcagataagtggagagaggagcaatgagaatgaagagaagaatgacaagtggcaccgtgtggagcggtcgagtgggaagttcacgaggaggtttaggctgccggagaatgctaagatggaggaaatcaaagccagtatggaaaatggtgtgttgtcggttaccgtgcccaaggtgccagagaaaaagccagaggttaagtccattgatatctctggttaaagggaattgtttaagaccaaaaatgtgtgatggtagtgaaataattggtgtgtgatgtgtttttcttgtaatcatgaatctcgttgtatcattatcataaaatcttaataagagtgtgttttgt

SEQ ID NO: 6209 - protein, 157 aa, Arabidopsis thaliana
  misc_feature (1)..(157): useful for making plants with modified plant phenotypes as described in USSN 12/139,269
  misc_feature (53)..(156): Pfam Name: HSP20; Pfam Description: Hsp20/alpha crystallin family
  misc_feature (53)..(156): Pfam Name: HSP20; Pfam Description: Hsp20/alpha crystallin family
  misc_feature (1)..(157): Utility: Useful for delaying flowering time
  misc_feature (1)..(157): Utility: Useful for increasing chlorophyll and photosynthetic capacity
  misc_feature (1)..(157): Utility: Useful for making ornamental plants with modified flowers
  misc_feature (1)..(157): Utility: Useful for making ornamental plants with modified leaves
  misc_feature (1)..(157): Utility: Useful for making plants sterile and for genetic confinement
  misc_feature (1)..(157): Utility: Useful for making plants with increased biomass
  misc_feature (1)..(157): Utility: Useful for making plants with increased biomass and foliage
  misc_feature (1)..(157): Utility: Useful for making smaller plants
  misc_feature (1)..(157): Utility: Useful for making stronger plants
MSLIPSIFGGRRTNVFDPFSLDVFDPFEGFLTPSGLANAPAKDVAAFTNAKVDWRETPEAHVFKADLPGLRKEEVKVEVEDGNILQISGERSNENEEKNDKWHRVERSSGKFTRRFRLPENAKMEEIKASMENGVLSVTVPKVPEKKPEVKSIDISG

SEQ ID NO: 6210 - protein, 161 aa, Arabidopsis thaliana
  misc_feature (1)..(161): useful for making plants with modified plant phenotypes as described in USSN 12/139,269
  misc_feature (1)..(161): Public GI no. 21689719
  misc_feature (1)..(161): Utility: Useful for delaying flowering time
  misc_feature (1)..(161): Utility: Useful for increasing chlorophyll and photosynthetic capacity
  misc_feature (1)..(161): Utility: Useful for making ornamental plants with modified flowers
  misc_feature (1)..(161): Utility: Useful for making ornamental plants with modified leaves
  misc_feature (1)..(161): Utility: Useful for making plants sterile and for genetic confinement
  misc_feature (1)..(161): Utility: Useful for making plants with increased biomass
  misc_feature (1)..(161): Utility: Useful for making plants with increased biomass and foliage
  misc_feature (1)..(161): Utility: Useful for making smaller plants
  misc_feature (1)..(161): Utility: Useful for making stronger plants
MSLIPSIFGGRRSNVFDPFSQDLWDPFEGFFTPSSALANASTARDVAAFTNARVDWKETPEAHVFKADLPGLKKEEVKVEVEDKNVLQISGERSKENEEKNDKWHRVERASGKFMRRFRLPENAKMEEVKATMENGVLTVVVPKAPEKKPQVKSIDISGAN

SEQ ID NO: 6211 - protein, 157 aa, Arabidopsis thaliana
  misc_feature (1)..(157): useful for making plants with modified plant phenotypes as described in USSN 12/139,269
  misc_feature (1)..(157): Public GI no. 2465461
  misc_feature (1)..(157): Utility: Useful for delaying flowering time
  misc_feature (1)..(157): Utility: Useful for increasing chlorophyll and photosynthetic capacity
  misc_feature (1)..(157): Utility: Useful for making ornamental plants with modified flowers
  misc_feature (1)..(157): Utility: Useful for making ornamental plants with modified leaves
  misc_feature (1)..(157): Utility: Useful for making plants sterile and for genetic confinement
  misc_feature (1)..(157): Utility: Useful for making plants with increased biomass
  misc_feature (1)..(157): Utility: Useful for making plants with increased biomass and foliage
  misc_feature (1)..(157): Utility: Useful for making smaller plants
  misc_feature (1)..(157): Utility: Useful for making stronger plants
MSLIPSFFGGRRTNVFDPFSLDLYDPFEGFLTPSGMTNATSKDVAAFTNAKVDWRETPEAHVFKADLPGLKKEEVKVEVEDGNILQISGERSSENEEKSDRWHRVERSSGKFMRRFKLPENAKVDEVKASMENGVLSVTVPKMAERKPEVKSIDISG

SEQ ID NO: 6212 - protein, 157 aa, Arabidopsis thaliana
  misc_feature (1)..(157): useful for making plants with modified plant phenotypes as described in USSN 12/139,269
  misc_feature (1)..(157): Public GI no. 8250119
  misc_feature (1)..(157): Utility: Useful for delaying flowering time
  misc_feature (1)..(157): Utility: Useful for increasing chlorophyll and photosynthetic capacity
  misc_feature (1)..(157): Utility: Useful for making ornamental plants with modified flowers
  misc_feature (1)..(157): Utility: Useful for making ornamental plants with modified leaves
  misc_feature (1)..(157): Utility: Useful for making plants sterile and for genetic confinement
  misc_feature (1)..(157): Utility: Useful for making plants with increased biomass
  misc_feature (1)..(157): Utility: Useful for making plants with increased biomass and foliage
  misc_feature (1)..(157): Utility: Useful for making smaller plants
  misc_feature (1)..(157): Utility: Useful for making stronger plants
MSLIPSFFGGRRTNVFDPFSLDLYDPFEGFLTPSGMTNTTSKDVAAFTNAKVDWRETAEAHVFKADLPGLKKEEVKVEVEDGNILKISGERSSENEEKSDKWHRVERSSGKFMRRFKLPENAKVDEVKASMENGVLSVTVPKMPERKPEVKSMDISG

SEQ ID NO: 6213 - protein, 157 aa, Arabidopsis thaliana
  misc_feature (1)..(157): useful for making plants with modified plant phenotypes as described in USSN 12/139,269
  misc_feature (1)..(157): Public GI no. 71495
  misc_feature (1)..(157): Utility: Useful for delaying flowering time
  misc_feature (1)..(157): Utility: Useful for increasing chlorophyll and photosynthetic capacity
  misc_feature (1)..(157): Utility: Useful for making ornamental plants with modified flowers
  misc_feature (1)..(157): Utility: Useful for making ornamental plants with modified leaves
  misc_feature (1)..(157): Utility: Useful for making plants sterile and for genetic confinement
  misc_feature (1)..(157): Utility: Useful for making plants with increased biomass
  misc_feature (1)..(157): Utility: Useful for making plants with increased biomass and foliage
  misc_feature (1)..(157): Utility: Useful for making smaller plants
  misc_feature (1)..(157): Utility: Useful for making stronger plants
MSIIPSFFGGRRSNVFDPFSLDVWDPFKDFPLVTSSASEFGKETAAFVNTHIDWKETPQAHVFKADLPGLKKEEVKVELEEGKVLQISGERNKEKEEKNDKWHRVERSSGKFLRRFRLPENAKVDEVKAAMANGVLTVTVPKVEIKKPEVKAIDISG

SEQ ID NO: 6214 - protein, 159 aa, Arabidopsis thaliana
  misc_feature (1)..(159): useful for making plants with modified plant phenotypes as described in USSN 12/139,269
  misc_feature (1)..(159): Public GI no. 5732912
  misc_feature (1)..(159): Utility: Useful for delaying flowering time
  misc_feature (1)..(159): Utility: Useful for increasing chlorophyll and photosynthetic capacity
  misc_feature (1)..(159): Utility: Useful for making ornamental plants with modified flowers
  misc_feature (1)..(159): Utility: Useful for making ornamental plants with modified leaves
  misc_feature (1)..(159): Utility: Useful for making plants sterile and for genetic confinement
  misc_feature (1)..(159): Utility: Useful for making plants with increased biomass
  misc_feature (1)..(159): Utility: Useful for making plants with increased biomass and foliage
  misc_feature (1)..(159): Utility: Useful for making smaller plants
  misc_feature (1)..(159): Utility: Useful for making stronger plants
MSLIPSFFDGRRSNIFDPFSLNIWDPFEGFPFSGTVANIPTSTRETAAFSSARIDWKETPESHVFKVDLPGIKKEEVKVEVEEGRVLQISGERSREQEEKNDKWHSMERSSGKFLRRFRLPENIKMEEIKATMENGVLTVTVPKMEEKKPEVKAIDISG

SEQ ID NO: 6215 - protein, 155 aa, Arabidopsis thaliana
  misc_feature (1)..(155): useful for making plants with modified plant phenotypes as described in USSN 12/139,269
  misc_feature (1)..(155): Public GI no. 18073562
  misc_feature (1)..(155): Utility: Useful for delaying flowering time
  misc_feature (1)..(155): Utility: Useful for increasing chlorophyll and photosynthetic capacity
  misc_feature (1)..(155): Utility: Useful for making ornamental plants with modified flowers
  misc_feature (1)..(155): Utility: Useful for making ornamental plants with modified leaves
  misc_feature (1)..(155): Utility: Useful for making plants sterile and for genetic confinement
  misc_feature (1)..(155): Utility: Useful for making plants with increased biomass
  misc_feature (1)..(155): Utility: Useful for making plants with increased biomass and foliage
  misc_feature (1)..(155): Utility: Useful for making smaller plants
  misc_feature (1)..(155): Utility: Useful for making stronger plants
MSIIPSLFAGRRSSVFDPFSLDVWDPFRDFPISSSSDVSRETSALVNARVDWKETPEAHVFKADLPGIKKEEVKVEVEDGNILQITGERNVEKEDKNDKWHRVERSSGKFTRRFRLPENAKMDQVKAAMENGVLTITVPKEEVKKPDVKSIEISG

SEQ ID NO: 6216 - protein, 154 aa, Arabidopsis thaliana
  misc_feature (1)..(154): useful for making plants with modified plant phenotypes as described in USSN 12/139,269
  misc_feature (1)..(154): Public GI no. 46359518
  misc_feature (1)..(154): Utility: Useful for delaying flowering time
  misc_feature (1)..(154): Utility: Useful for increasing chlorophyll and photosynthetic capacity
  misc_feature (1)..(154): Utility: Useful for making ornamental plants with modified flowers
  misc_feature (1)..(154): Utility: Useful for making ornamental plants with modified leaves
  misc_feature (1)..(154): Utility: Useful for making plants sterile and for genetic confinement
  misc_feature (1)..(154): Utility: Useful for making plants with increased biomass
  misc_feature (1)..(154): Utility: Useful for making plants with increased biomass and foliage
  misc_feature (1)..(154): Utility: Useful for making smaller plants
  misc_feature (1)..(154): Utility: Useful for making stronger plants
MALSLFGGRRSNVFDPFSLDIWDPFEGFSAVANVPPSARETTAFATARIDWKETPEAHIFKADLPGLKKEEVKVEVEDGNVLQISGERSKEHEEKNDKWHRVERSCGKFLRRFRLPENAKVEQVKANMENGVLTVIVPKEEQKKTEVKSIEISG

SEQ ID NO: 6217 - protein, 157 aa, Parthenium argentatum
  misc_feature (1)..(157): useful for making plants with modified plant phenotypes as described in USSN 12/139,269
  misc_feature (1)..(157): Ceres CLONE ID no. 1609909
  misc_feature (1)..(157): Utility: Useful for delaying flowering time
  misc_feature (1)..(157): Utility: Useful for increasing chlorophyll and photosynthetic capacity
  misc_feature (1)..(157): Utility: Useful for making ornamental plants with modified flowers
  misc_feature (1)..(157): Utility: Useful for making ornamental plants with modified leaves
  misc_feature (1)..(157): Utility: Useful for making plants sterile and for genetic confinement
  misc_feature (1)..(157): Utility: Useful for making plants with increased biomass
  misc_feature (1)..(157): Utility: Useful for making plants with increased biomass and foliage
  misc_feature (1)..(157): Utility: Useful for making smaller plants
  misc_feature (1)..(157): Utility: Useful for making stronger plants
MSIIPSIFGGRRTNVFDPFSLDIWDPFFNTSISNIIPAGARETSAFANAQIDWKETPEAHVFKADLPGLKKEEVKVELQEDRILQISGERSREKEEKNDKWHRVERSSGKFLRRFRLPENAKVDEVKAKMENGVLTVTVPKKEVKKPEVKAIDISAN

SEQ ID NO: 6218 - protein, 155 aa, Parthenium argentatum
  misc_feature (1)..(155): useful for making plants with modified plant phenotypes as described in USSN 12/139,269
  misc_feature (1)..(155): Public GI no. 56606538
  misc_feature (1)..(155): Utility: Useful for delaying flowering time
  misc_feature (1)..(155): Utility: Useful for increasing chlorophyll and photosynthetic capacity
  misc_feature (1)..(155): Utility: Useful for making ornamental plants with modified flowers
  misc_feature (1)..(155): Utility: Useful for making ornamental plants with modified leaves
  misc_feature (1)..(155): Utility: Useful for making plants sterile and for genetic confinement
  misc_feature (1)..(155): Utility: Useful for making plants with increased biomass
  misc_feature (1)..(155): Utility: Useful for making plants with increased biomass and foliage
  misc_feature (1)..(155): Utility: Useful for making smaller plants
  misc_feature (1)..(155): Utility: Useful for making stronger plants
MALIPSIFGGRRSNVFDPFSHDIWDPFQGLSSALANARDQETAAIANTRIDWKETPEAHVFKADLPGLKKEEIKVEVEDGRVLQISGERSKEQEEKTDTWHRVERSVGKFHRRFRLPENAKVDQVTASMENGVLTVTVPKKEEKEPEVKAIDISG

SEQ ID NO: 6219 - DNA, 1194 bp, Arabidopsis thaliana
  misc_feature (1)..(1194): useful for making plants with modified plant phenotypes as described in USSN 12/139,269
  misc_feature (1)..(1194): Ceres CLONE ID no. 1020202
  misc_feature (1)..(1194): Also known as  Ceres CDNA ID no. 23557695
atcttgttgttgttgtggtgatttaggtttgaggagatgtagcaaaagctgtagattgaggtggactaattatcttcgacctgggatcaagcgtggaaatttcaccgagcatgaagagaagatgattctccatcttcaagctcttttgggaaacaggtgggcagctatagcatcatatcttccagaaaggacagacaatgatataaagaactattggaacactcatttgaagaaaaagctcaagaagatgaatgattcttgtgatagtactatcaacaatggccttgataataaagacttctccatatcaaacaaaaacactacctcacatcaaagcagcaactccagtaaaggtcaatgggagagaaggcttcagacagatatcaacatggctaaacaagctctttgtgatgccttgtctattgacaaaccacaaaacccaactaatttttctattcccgatcttggttatggtccatcatcttcttcgtcctctaccaccaccaccaccaccaccaccaccacgagaaacactaatccatacccatctggggtctatgcttcaagtgctgagaacattgctcgtttgcttcagaattttatgaaagacacaccaaagacctcggtgcccttgccggttgcagccaccgagatggctatcaccacggcagcttcgagccctagcacaaccgaaggagacggagaagggattgaccattctttgttcagcttcaactccatagatgaagctgaagagaagcctaaactaatagaccatgacattaatggtctaattacacaaggctctctttctttgttcgagaaatggctctttgatgagcaaagccacgatatgatcatcaataacatgtcactagagggtcaggaagtgttgttctagaaagcattaaagtttgacgatttgcttgaggaaccacgaggcttagttataaacaatttgtataattaagtactctttagttttgttttcaatccttattatgatcatattgcagtaattagggattttagtctttagtagtaactcttaagttttaacacatttttctctatctttttagtagtaactctttattttttccttaaatctttgtcgacgtggagatgatatcttctatgtagtagaaactcaaaagtgtacatcatctttattaatgtaacgtctttttaagc

SEQ ID NO: 6220 - protein, 259 aa, Arabidopsis thaliana
  misc_feature (1)..(259): useful for making plants with modified plant phenotypes as described in USSN 12/139,269
  misc_feature (2)..(36): Pfam Name: Myb_DNA-binding; Pfam Description: Myb-like DNA-binding domain
  misc_feature (2)..(36): Pfam Name: Myb_DNA-binding; Pfam Description: Myb-like DNA-binding domain
  misc_feature (1)..(259): Utility: Useful for delaying flowering time
  misc_feature (1)..(259): Utility: Useful for increasing chlorophyll and photosynthetic capacity
  misc_feature (1)..(259): Utility: Useful for making larger plants
  misc_feature (1)..(259): Utility: Useful for making ornamental plants with modified flowers
  misc_feature (1)..(259): Utility: Useful for making ornamental plants with modified leaves
  misc_feature (1)..(259): Utility: Useful for making plants sterile and for genetic confinement
  misc_feature (1)..(259): Utility: Useful for making plants with increased biomass
  misc_feature (1)..(259): Utility: Useful for making plants with increased biomass and foliage
  misc_feature (1)..(259): Utility: Useful for making smaller plants
  misc_feature (1)..(259): Utility: Useful for making stronger plants
MILHLQALLGNRWAAIASYLPERTDNDIKNYWNTHLKKKLKKMNDSCDSTINNGLDNKDFSISNKNTTSHQSSNSSKGQWERRLQTDINMAKQALCDALSIDKPQNPTNFSIPDLGYGPSSSSSSTTTTTTTTTTRNTNPYPSGVYASSAENIARLLQNFMKDTPKTSVPLPVAATEMAITTAASSPSTTEGDGEGIDHSLFSFNSIDEAEEKPKLIDHDINGLITQGSLSLFEKWLFDEQSHDMIINNMSLEGQEVLF

SEQ ID NO: 6221 - DNA, 960 bp, Glycine max
  misc_feature (1)..(960): useful for making plants with modified plant phenotypes as described in USSN 12/139,269
  misc_feature (1)..(960): Ceres CLONE ID no. 1043081
  misc_feature (1)..(960): Also known as  Ceres CDNA ID no. 25447431
acaaattctatacaccactctatcccccgttctctctcgcccgctttggtaaggcaagatagttctggccaacatggtgcaatcaaggaaattcagaggtgtgaggcaacgcaattggggctcttgggtttctgagattcgtcacccattattgaaaaggagggtgtggcttgggacattcgagacagctgatgaagcagctagagcatatgatgaggccgccattttgatgagtggaagaaatgccaaaacaaacttcccagttggtgaaaaccaaatgggaaatcatagttcaagtacttcatcttcctccaccactacattgtctgcagttctgagtgcaaaacttaggaagtgttgcaagtccccttcaccttccctcacttgcctgaggcttgacactgagaattcccacattggtgtgtggcagaagcgagcaggccctcgttctgactcaaactggatcatgatggttgagttggaaaagaagaacaacaagggtccttcttctgaatccgaattgcctgttgttgttgttgatgatgatgccccagagaaggtaaagcctgaggaaagcactggcttagatgaggaacagaaaatggccctacagatgatagaggaacttctgaataggaattgaattgaattgaattgaattagccccatcatcccaacatgcttttactttcacgtggtgcatgcaaggagtttgcaagttcaagtccccttctctagtccctttcacttcgttttatttctttgtttgtcccaaataggagataggagagtgagagagctactatattcatttcgtgaggaataaggatgtttagtgtctgtggctctgaatgtttccccatgtgtgcgtaactccctacctacacttctcgctgtggttaaacttcatttcctctgtcaaaaaaactattccttgcttttcgaaaaaaaaaaaaaaaa

SEQ ID NO: 6222 - protein, 189 aa, Glycine max
  misc_feature (1)..(189): useful for making plants with modified plant phenotypes as described in USSN 12/139,269
  misc_feature (5)..(68): Pfam Name: AP2; Pfam Description: AP2 domain
  misc_feature (1)..(189): Utility: Useful for delaying flowering time
  misc_feature (1)..(189): Utility: Useful for increasing chlorophyll and photosynthetic capacity
  misc_feature (1)..(189): Utility: Useful for making plants with enhanced abiotic stress tolerance
  misc_feature (1)..(189): Utility: Useful for making plants with increased biomass
MVQSRKFRGVRQRNWGSWVSEIRHPLLKRRVWLGTFETADEAARAYDEAAILMSGRNAKTNFPVGENQMGNHSSSTSSSSTTTLSAVLSAKLRKCCKSPSPSLTCLRLDTENSHIGVWQKRAGPRSDSNWIMMVELEKKNNKGPSSESELPVVVVDDDAPEKVKPEESTGLDEEQKMALQMIEELLNRN

SEQ ID NO: 6223 - protein, 200 aa, Glycine max
  misc_feature (1)..(200): useful for making plants with modified plant phenotypes as described in USSN 12/139,269
  misc_feature (1)..(200): Ceres CLONE ID no. 556472
  misc_feature (1)..(200): Utility: Useful for delaying flowering time
  misc_feature (1)..(200): Utility: Useful for increasing chlorophyll and photosynthetic capacity
  misc_feature (1)..(200): Utility: Useful for making plants with enhanced abiotic stress tolerance
  misc_feature (1)..(200): Utility: Useful for making plants with increased biomass
MVQSRKFRGVRQRHWGSWVSEIRHPLLKRRVWLGTFETAEEAARAYDEAAILMSGRNAKTNFPVGENQIVGNHSSNTSSSSTTTLSAVLSAKLRKCCKSPSPSLTCLRLDTENSHIGVWQKRAGPRSDSNWIMMVELENKNNDNEGDHHQGPSSSDDSEFPVVVVDVDAQEKVKPEEESTGLDEEQKMALQMIEELLNRN

SEQ ID NO: 6224 - protein, 199 aa, Glycine max
  misc_feature (1)..(199): useful for making plants with modified plant phenotypes as described in USSN 12/139,269
  misc_feature (1)..(199): Public GI no. 28950721
  misc_feature (1)..(199): Utility: Useful for delaying flowering time
  misc_feature (1)..(199): Utility: Useful for increasing chlorophyll and photosynthetic capacity
  misc_feature (1)..(199): Utility: Useful for making plants with enhanced abiotic stress tolerance
  misc_feature (1)..(199): Utility: Useful for making plants with increased biomass
MVQTKKFRGVRQRHWGSWVAEIRHPLLKRRIWLGTFETAEEAARAYDEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 6225 - protein, 199 aa, Arabidopsis thaliana
  misc_feature (1)..(199): useful for making plants with modified plant phenotypes as described in USSN 12/139,269
  misc_feature (1)..(199): Ceres CLONE ID no. 17356
  misc_feature (1)..(199): Utility: Useful for delaying flowering time
  misc_feature (1)..(199): Utility: Useful for increasing chlorophyll and photosynthetic capacity
  misc_feature (1)..(199): Utility: Useful for making plants with enhanced abiotic stress tolerance
  misc_feature (1)..(199): Utility: Useful for making plants with increased biomass
MVQTKKFRGVRQRHWGSWVAEIRHPLLKRRIWLGTFETAEEAARAYHEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 6226 - protein, 199 aa, Arabidopsis thaliana; identical to SEQ ID NO: 6225
  misc_feature (1)..(199): useful for making plants with modified plant phenotypes as described in USSN 12/139,269
  misc_feature (1)..(199): Public GI no. 21553845
  misc_feature (1)..(199): Utility: Useful for delaying flowering time
  misc_feature (1)..(199): Utility: Useful for increasing chlorophyll and photosynthetic capacity
  misc_feature (1)..(199): Utility: Useful for making plants with enhanced abiotic stress tolerance
  misc_feature (1)..(199): Utility: Useful for making plants with increased biomass

SEQ ID NO: 6227 - protein, 213 aa, Zea mays
  misc_feature (1)..(213): useful for making plants with modified plant phenotypes as described in USSN 12/139,269
  misc_feature (1)..(213): Ceres CLONE ID no. 224679
  misc_feature (1)..(213): Utility: Useful for delaying flowering time
  misc_feature (1)..(213): Utility: Useful for increasing chlorophyll and photosynthetic capacity
  misc_feature (1)..(213): Utility: Useful for making plants with enhanced abiotic stress tolerance
  misc_feature (1)..(213): Utility: Useful for making plants with increased biomass
MTENLHSRKMVQPKKFRGVRQRHWGSWVSEIRHPLLKRRVWLGTFETAEEAARAYDEAAVLMSGRNAKTNFPIQRSSTGEPTPAAGRDARSNFSSGSSTTNLSQILSAKLRKCCKAPSPSLTCLRLDPEKSHIGVWQKRAGARADSNWVMTVELNKDAASTDAASQSTSATTAPPATPMDEEERIALQMIEELLSSSSPASPSNGDDQGRFII

SEQ ID NO: 6228 - protein, 205 aa, Zea mays
  misc_feature (1)..(205): useful for making plants with modified plant phenotypes as described in USSN 12/139,269
  misc_feature (1)..(205): Public GI no. 50906071
  misc_feature (1)..(205): Utility: Useful for delaying flowering time
  misc_feature (1)..(205): Utility: Useful for increasing chlorophyll and photosynthetic capacity
  misc_feature (1)..(205): Utility: Useful for making plants with enhanced abiotic stress tolerance
  misc_feature (1)..(205): Utility: Useful for making plants with increased biomass
MVQPKKKFRGVRQRHWGSWVSEIRHPLLKRRVWLGTFETAEEAARAYDEAAVLMSGRNAKTNFPVQRNSTGDLATAADQDARSNGGSRNSSAGNLSQILSAKLRKCCKAPSPSLTCLRLDPEKSHIGVWQKRAGARADSNWVMTVELNKEVEPTEPAAQPTSTATASQVTMDDEEKIALQMIEELLSRSSPASPSHGEGEGSFVI

SEQ ID NO: 6229 - protein, 228 aa, Zea mays
  misc_feature (1)..(228): useful for making plants with modified plant phenotypes as described in USSN 12/139,269
  misc_feature (1)..(228): Ceres CLONE ID no. 302607
  misc_feature (1)..(228): Utility: Useful for delaying flowering time
  misc_feature (1)..(228): Utility: Useful for increasing chlorophyll and photosynthetic capacity
  misc_feature (1)..(228): Utility: Useful for making plants with enhanced abiotic stress tolerance
  misc_feature (1)..(228): Utility: Useful for making plants with increased biomass
MGAAVKEEEVPRRQAAPLGLLGSPRSGTRCSRGGVWLGTFETAEEAARAYDEAAVLMSGRNAKTNFPVLPCGRTRGGGGGGGSSGNNTNASASTSTSNLSQVLSAKLRRCCKAPSPSLTCLRLDPERSHIGVWHKGAGARADSSWVMTVQLSDKDAAPAPSATSSATATTTTAASHPPPATVVVVDDEERIALQMIEELLGGGGGPVSQQPLGNGMLQIAAAGGGLVI

SEQ ID NO: 6230 - DNA, 399 bp, Brassica napus
  misc_feature (1)..(399): useful for making plants with modified plant phenotypes as described in USSN 12/139,269
  misc_feature (1)..(399): Ceres CLONE ID no. 1105554
  misc_feature (1)..(399): Also known as  Ceres CDNA ID no. 6424924
  misc_feature (93)..(93): n is a, c, t, g, unknown, or other
  misc_feature (94)..(94): n is a, c, t, g, unknown, or other
  misc_feature (95)..(95): r is g or a
  misc_feature (139)..(139): r is g or a
aaaaattagggtttgttgtttctctctttctttcgcaattttcaaagtaatccaatcggaatcaagtcaaaacacctatcttagccacaccannragagatctgacttctaaaagatgatgaccaacttgtctcttgcragagaaggagaagcagaagcaaagaagcccatagaaaaagttgagagagagcacatgttcgacaaagtggtgactccaagcgacgtagggaaactaaaccggctcgtgatcccaaagcaacacgcagaaagatacttccctctagattcatcctcaaacgggaaaggtttgcttttaaacttcgaagatctaacaggaaagtcatggaggttccgttactcttactggaacagtagccagagctatgtcatgactaaagg

SEQ ID NO: 6231 - protein, 94 aa, Brassica napus
  misc_feature (1)..(94): useful for making plants with modified plant phenotypes as described in USSN 12/139,269
  misc_feature (27)..(94): Pfam Name: B3; Pfam Description: B3 DNA binding domain
  misc_feature (27)..(94): Pfam Name: B3; Pfam Description: B3 DNA binding domain
  misc_feature (1)..(94): Utility: Useful for delaying flowering time
  misc_feature (1)..(94): Utility: Useful for increasing chlorophyll and photosynthetic capacity
  misc_feature (1)..(94): Utility: Useful for making ornamental plants with modified flowers
  misc_feature (1)..(94): Utility: Useful for making ornamental plants with modified leaves
  misc_feature (1)..(94): Utility: Useful for making plants with increased biomass
  misc_feature (1)..(94): Utility: Useful for making plants with increased biomass and foliage
  misc_feature (1)..(94): Utility: Useful for making smaller plants
  misc_feature (8)..(8): Xaa is any aa, unknown or other
MMTNLSLXREGEAEAKKPIEKVEREHMFDKVVTPSDVGKLNRLVIPKQHAERYFPLDSSSNGKGLLLNFEDLTGKSWRFRYSYWNSSQSYVMTK

SEQ ID NO: 6232 - DNA, 467 bp, Glycine max
  misc_feature (1)..(467): useful for making plants with modified plant phenotypes as described in USSN 12/139,269
  misc_feature (1)..(467): Ceres CLONE ID no. 1120124
  misc_feature (1)..(467): Also known as  Ceres CDNA ID no. 4865327
  misc_feature (387)..(387): y is t/u or c
  misc_feature (388)..(388): y is t/u or c
aaaaacaaaatagtctctcttctctcaaacgattacaaaaaaatgacgtcatccaaccgttcttcatcaccaacatcatcgtcttcggaccaatctgatgtaactacaacaacaagcacccacttgtccgaaacttcaccgagaaacaacaaaagaaagagaagcaaggattcttcttcttcttcttcttcctcttcttcaaagcttaagcatcctgtttacagaggtgtacggatgagaagctggggcaaatgggtctccgagatccgacagcctcgcaaaaagactcgaatctggctcggtacattcgccaccgcagacatggcggcgcgtgctcacgacgtcgctgctctcgccatcaaaggctcctccgccgtcatcaacttyyccggagcttgcctctatcctccctcgtccggcgtcatcctcgccgcatgatatccaagcagcagctgcggaagccgccg

SEQ ID NO: 6233 - protein, 131 aa, Brassica napus
  misc_feature (1)..(131): useful for making plants with modified plant phenotypes as described in USSN 12/139,269
  misc_feature (58)..(114): Pfam Name: AP2; Pfam Description: AP2 domain
  misc_feature (58)..(114): Pfam Name: AP2; Pfam Description: AP2 domain
  misc_feature (1)..(131): Utility: Useful for delaying flowering time
  misc_feature (1)..(131): Utility: Useful for increasing chlorophyll and photosynthetic capacity
  misc_feature (1)..(131): Utility: Useful for making ornamental plants with modified flowers
  misc_feature (1)..(131): Utility: Useful for making plants with increased biomass and foliage
  misc_feature (1)..(131): Utility: Useful for making smaller plants
  misc_feature (115)..(115): Xaa is any aa, unknown or other
  misc_feature (116)..(116): Xaa is any aa, unknown or other
MTSSNRSSSPTSSSSDQSDVTTTTSTHLSETSPRNNKRKRSKDSSSSSSSSSSKLKHPVYRGVRMRSWGKWVSEIRQPRKKTRIWLGTFATADMAARAHDVAALAIKGSSAVINXXGACLYPPSSGVILAA

SEQ ID NO: 6234 - DNA, 524 bp, Brassica napus
  misc_feature (1)..(524): useful for making plants with modified plant phenotypes as described in USSN 12/139,269
  misc_feature (1)..(524): Ceres CLONE ID no. 1124135
  misc_feature (1)..(524): Also known as  Ceres CDNA ID no. 4852507
aactagcaaaaaagatatacaaaacatttgtttaccctcatagagaaataagaaggatgaacacaacatcgtcaaagagcaagaagaagcaagaagagggtagtgcgaggtttcttggggtgagaaggaggccttggggaagatacgcggctgagattagagacccaacaaccaaggagcgtcactggcttggcacatttgatacggccgaggaagctgccttggcctacgatagagccgccaggtccatgcgtggcactcgtgcccgaaccaacttcgtctactcagacatgcctccttcatcctccgtcacctccattatttctcctgatgatccgcctccccctccacctcctactgcagctgctcctccttgttctaatgatcctgtggattacatggtgatgtttaaccaatattcatcaacagattcgctaatgctgcagcctcattctgatcaagtggagagtagttacatgtttggtggctcctcttcttgttattctaacagcagcagcgagttg

SEQ ID NO: 6235 - protein, 156 aa, Brassica napus
  misc_feature (1)..(156): useful for making plants with modified plant phenotypes as described in USSN 12/139,269
  misc_feature (17)..(74): Pfam Name: AP2; Pfam Description: AP2 domain
  misc_feature (17)..(74): Pfam Name: AP2; Pfam Description: AP2 domain
  misc_feature (1)..(156): Utility: Useful for delaying flowering time
  misc_feature (1)..(156): Utility: Useful for increasing chlorophyll and photosynthetic capacity
  misc_feature (1)..(156): Utility: Useful for making plants with altered leaf shape eg curled leaves
  misc_feature (1)..(156): Utility: Useful for making plants with increased biomass and foliage
  misc_feature (1)..(156): Utility: Useful for making smaller plants
MNTTSSKSKKKQEEGSARFLGVRRRPWGRYAAEIRDPTTKERHWLGTFDTAEEAALAYDRAARSMRGTRARTNFVYSDMPPSSSVTSIISPDDPPPPPPPTAAAPPCSNDPVDYMVMFNQYSSTDSLMLQPHSDQVESSYMFGGSSSCYSNSSSEL

SEQ ID NO: 6236 - DNA, 403 bp, Arabidopsis thaliana
  misc_feature (1)..(403): useful for making plants with modified plant phenotypes as described in USSN 12/139,269
  misc_feature (1)..(403): Ceres CLONE ID no. 38416
  misc_feature (1)..(403): Also known as  Ceres CDNA ID no. 23386006
aatttgcacccaatttcttcgaatcaacttatcaatggcctcatcagctgcgatgttcatgctccctcttcctctaactcagcagataacaacaaacaatactctgcagactacagccacaccggaaccgtcagcctccatagttaaatgcctttttccggcgagaaactcatcggaaagttctgctcgttcgaagtttagtctttggctatttggcaatcccgctacgtatgacaagaggttccaagaagctattgaacttagttgcttgtgatggagatttggagatttttcctagtctttttcttgtgttttttaaatggacatattgtaatttcttcccaagtctcaccctccgctgtaatttatctaataatcaattcgatcaaagatgttccgactg

SEQ ID NO: 6237 - protein, 79 aa, Arabidopsis thaliana
  misc_feature (1)..(79): useful for making plants with modified plant phenotypes as described in USSN 12/139,269
  misc_feature (1)..(79): Utility: Useful for delaying senescence
  misc_feature (1)..(79): Utility: Useful for increasing chlorophyll and photosynthetic capacity
  misc_feature (1)..(79): Utility: Useful for making ornamental plants with modified flowers
  misc_feature (1)..(79): Utility: Useful for making plants sterile and for genetic confinement
  misc_feature (1)..(79): Utility: Useful for making smaller plants
  misc_feature (1)..(79): Utility: Useful for modifying plant structure, ie increased branching
MASSAAMFMLPLPLTQQITTNNTLQTTATPEPSASIVKCLFPARNSSESSARSKFSLWLFGNPATYDKRFQEAIELSCL

SEQ ID NO: 6238 - DNA, 2019 bp, Arabidopsis thaliana
  misc_feature (1)..(2019): useful for making plants with modified plant phenotypes as described in USSN 12/139,269
  misc_feature (1)..(2019): Ceres CLONE ID no. 99298
  misc_feature (1)..(2019): Also known as  Ceres CDNA ID no. 23363651
gtaaatcaaaagagaactaaaccaagaaacaaaatgggatacgaaaggctcggaccatccggagcaactggttcggtcaccacctccactactacagctccaatccttaaccaagtctccacgtcagaacaaccggagaacaacaaccgaagaagcaaaaagaagcttgtagtatcatctatcgtcttagccatctcacttatcctcgccgccgcgatcttcgccggagtcagatcacgtctcaagttaaaccaatcagtcccaggcctagctcgtaaaccgagtcaagcaatctctaaagcttgtgagttaactcgtttccccgagttatgcgttgactcactcatggactttcccggctcactcgccgcttcctcctctaaagatctcatccacgtgactgtgaacatgacgctccaccacttcagccacgctctctactcgtctgcttccctctccttcgtcgacatgccgccacgtgctcgctcagcttacgactcttgcgtcgagctacttgacgattccgttgacgcgctatcacgcgctctttcctccgtcgtatcctcctccgctaagccgcaagatgttacaacgtggcttagcgcggctttaacaaaccatgacacgtgtactgaaggattcgacggcgtcgacgacggtggagtgaaggatcatatgacggcggcgttacagaatctttctgagcttgttagtaactgtcttgctatattctcggcgagtcacgacggtgacgatttcgccggagttccaatacagaacaggaggctgctgggagtggaggaacgagaagagaaattcccgagatggatgagaccaaaagaacgcgagatactggaaatgccggtatctcagatacaagctgatattatcgtatcgaaagacggtaacggcacgtgcaaaactatatcggaagctatcaagaaagctcctcagaacagtactcgccggataattatctacgtcaaggccggaagatatgaagagaacaacctcaaggtcggtaggaaaaaaattaatttgatgttcgttggagatggcaagggtaaaactgttatttcgggaggcaaaagtatatttgacaacatcactactttccacacggcgtcatttgctgcgaccggagctggatttattgcaagggacatcacattcgaaaactgggccggtccagcgaagcaccaagccgtggctctccgcatcggagctgaccacgcagtgatctaccgatgcaatataatcggttaccaagacacactctacgtccattcaaaccgccaattctttcgtgaatgcgatatctacggtacagtcgattttatctttggtaacgcagccgtcgtactacaaaactgtagcatctacgcacggaagccaatggattttcagaaaaatacaatcacggctcaaaacagaaaagatccgaaccaaaacaccggaatatcaatacatgcgtctagggttcttgcagcatccgatctccaagcgacaaacggtagtacacagacgtatctaggccgaccttggaagctattctctaggacagtgtatatgatgtcgtatatcggtggtcatgtacacacgagaggttggctcgagtggaacacaacatttgctttagatactttgtattacggagagtatttgaacagtggacctgggtcgggtctcgggcaacgtgtgagctggccgggttatcgggtcatcaattcgacggccgaggcaaaccggttcactgtggcagaatttatatacggttcctcgtggttgccatcgaccggagtttcgttcttggccggattaagcatataggtagagaaaaaattgaaatgcttatttttccgatgaattgtttcattcttacggtccttatattaatggacatatcagtattccaatatatatgagtatattttaactttaattgtaatgtctccactctccagaggtattattcaataatagatgaacactcgaggataattttcccttgttttcttg

SEQ ID NO: 6239 - protein, 598 aa, Arabidopsis thaliana
  misc_feature (1)..(598): useful for making plants with modified plant phenotypes as described in USSN 12/139,269
  misc_feature (81)..(232): Pfam Name: PMEI; Pfam Description: Plant invertase/pectin methylesterase inhibitor
  misc_feature (81)..(232): Pfam Name: PMEI; Pfam Description: Plant invertase/pectin methylesterase inhibitor
  misc_feature (284)..(583): Pfam Name: Pectinesterase; Pfam Description: Pectinesterase
  misc_feature (284)..(583): Pfam Name: Pectinesterase; Pfam Description: Pectinesterase
  misc_feature (1)..(598): Utility: Useful for delaying senescence
MGYERLGPSGATGSVTTSTTTAPILNQVSTSEQPENNNRRSKKKLVVSSIVLAISLILAAAIFAGVRSRLKLNQSVPGLARKPSQAISKACELTRFPELCVDSLMDFPGSLAASSSKDLIHVTVNMTLHHFSHALYSSASLSFVDMPPRARSAYDSCVELLDDSVDALSRALSSVVSSSAKPQDVTTWLSAALTNHDTCTEGFDGVDDGGVKDHMTAALQNLSELVSNCLAIFSASHDGDDFAGVPIQNRRLLGVEEREEKFPRWMRPKEREILEMPVSQIQADIIVSKDGNGTCKTISEAIKKAPQNSTRRIIIYVKAGRYEENNLKVGRKKINLMFVGDGKGKTVISGGKSIFDNITTFHTASFAATGAGFIARDITFENWAGPAKHQAVALRIGADHAVIYRCNIIGYQDTLYVHSNRQFFRECDIYGTVDFIFGNAAVVLQNCSIYARKPMDFQKNTITAQNRKDPNQNTGISIHASRVLAASDLQATNGSTQTYLGRPWKLFSRTVYMMSYIGGHVHTRGWLEWNTTFALDTLYYGEYLNSGPGSGLGQRVSWPGYRVINSTAEANRFTVAEFIYGSSWLPSTGVSFLAGLSI

SEQ ID NO: 6240 - protein, 587 aa, Arabidopsis thaliana
  misc_feature (1)..(587): useful for making plants with modified plant phenotypes as described in USSN 12/139,269
  misc_feature (1)..(587): Public GI no. 15293287
  misc_feature (1)..(587): Utility: Useful for delaying senescence
MGYDRLGPSGPSNPNQKDPATSLPELQKKTKTKLILFTLAVLVVGVVCFGIFAGIRAVDSGKTEPKLTRKPTQAISRTCSKSLYPNLCIDTLLDFPGSLTADENELIHISFNATLQKFSKALYTSSTITYTQMPPRVRSAYDSCLELLDDSVDALTRALSSVVVVSGDESHSDVMTWLSSAMTNHDTCTDGFDEIEGQGGEVKDQVIGAVKDLSEMVSNCLAIFAGKVKDLSGVPVVNNRKLLGTEETEELPNWLKREDRELLGTPTSAIQADITVSKDGSGTFKTIAEAIKKAPEHSSRRFVIYVKAGRYEEENLKVGRKKTNLMFIGDGKGKTVITGGKSIADDLTTFHTATFAATGAGFIVRDMTFENYAGPAKHQAVALRVGGDHAVVYRCNIIGYQDALYVHSNRQFFRECEIYGTVDFIFGNAAVILQSCNIYARKPMAQQKITITAQNRKDPNQNTGISIHACKLLATPDLEASKGSYPTYLGRPWKLYSRVVYMMSDMGDHIDPRGWLEWNGPFALDSLYYGEYMNKGLGSGIGQRVKWPGYHVITSTVEASKFTVAQFISGSSWLPSTGVSFFSGLSQ

SEQ ID NO: 6241 - protein, 584 aa, Arabidopsis thaliana
  misc_feature (1)..(584): useful for making plants with modified plant phenotypes as described in USSN 12/139,269
  misc_feature (1)..(584): Public GI no. 2098711
  misc_feature (1)..(584): Utility: Useful for delaying senescence
MTHIKEFFTKLSESSSNQNISNIPKKKKKLFLALFATLLVVAAVIGIVAGVNSRKNSGDNGNEPHHAILKSSCSSTRYPDLCFSAIAAVPEASKKVTSQKDVIEMSLNITTTAVEHNYFGIQKLLKRTNLTKREKVALHDCLETIDETLDELHKAVEDLEEYPNKKSLSQHADDLKTLMSAAMTNQGTCLDGFSHDDANKHVRDALSDGQVHVEKMCSNALAMIKNMTDTDMMIMRTSNNRKLTEETSTVDGWPAWLSPGDRRLLQSSSVTPNAVVAADGSGNFKTVAAAVAAAPQGGTKRYIIRIKAGVYRENVEVTKKHKNIMFIGDGRTRTIITGSRNVVDGSTTFKSATVAVVGEGFLARDITFQNTAGPSKHQAVALRVGADLSAFYNCDMLAYQDTLYVHSNRQFFVNCLIAGTVDFIFGNAAAVLQNCDIHARKPNSGQKNMVTAQGRTDPNQNTGIVIQKSRIGATSDLKPVQGSFPTYLGRPWKEYSRTVIMQSSITDLIHPAGWHEWDGNFALNTLFYGEHQNSGAGAGTSGRVKWKGFRVITSATEAQAFTPGSFIAGSSWLGSTGFPFSLGL

SEQ ID NO: 6242 - protein, 584 aa, Arabidopsis thaliana
  misc_feature (1)..(584): useful for making plants with modified plant phenotypes as described in USSN 12/139,269
  misc_feature (1)..(584): Public GI no. 57014097
  misc_feature (1)..(584): Utility: Useful for delaying senescence
MTRIKEFFTKLSESSTNQNISNIPKKKKKLFLALFATLLVVAAVIGIVAGVNSRKNSGDNGNEPHHAILKSSCSSTRYPDLCFSAIAAVPEASKKVTSQKDVIEMSLNITTTAVEHNYFGIQKLLKRTNLTKREKVALHDCLETIDETLDELHKAVEDLEEYPNKKSLSQHADDLKTLMSAAMTNQGTCLDGFSHDDANKHVRDALSDGQVHVEKMCSNALAMIKNMTDTDMMIMRTSNNRKLIEETSTVDGWPAWLSTGDRRLLQSSSVTPNVVVAADGSGNFKTVAASVAAAPQGGTKRYIIRIKAGVYRENVEVTKKHKNIMFIGDGRTRTIITGSRNVVDGSTTFKSATVAVVGEGFLARDITFQNTAGPSKHQAVALRVGADLSAFYNCDMLAYQDTLYVHSNRQFFVNCLIAGTVDFIFGNAAAVLQNCDIHARKPNSGQKNMVTAQGRADPNQNTGIVIQKSRIGATSDLKPVQGSFPTYLGRPWKEYSRTVIMQSSITDVIHPAGWHEWDGNFALNTLFYGEHQNAGAGAGTSGRVKWKGFRVITSATEAQAFTPGSFIAGSSWLGSTGFPFSLGL

SEQ ID NO: 6243 - protein, 579 aa, Arabidopsis thaliana
  misc_feature (1)..(579): useful for making plants with modified plant phenotypes as described in USSN 12/139,269
  misc_feature (1)..(579): Public GI no. 8671350
  misc_feature (1)..(579): Utility: Useful for delaying senescence
MLDSGKNVNFSKGKKKLFLTVVASVLLVAAVIGVVVGVKFRSNNSDDHADIQAITSAAHAIVKSACENTLHPELCYSTIASVSDFSKKVTSQKDVIELSLNITCRAVQHNFFKVEKLIKTRKGLKPREKVALHDCLETIDETLDELHTAIKDLELYPNKKSLKAHADDLKTLISSAITNQETCLDGFSHDDADKKVRKALLKGQKHVEKMCSNALAMICNMTDTDIANEQKLKGTTTNRKLREDNSEWPEWLSAGDRRLLQSSTVRPDVVVAADGSGNFKTVSEAVAKAPEKSSKRYVIRIKAGVYRENVDVPKKKTNIMFMGDGRSNTIITGSRNVKDGSTTFHSATVAAVGEKFLARDITFQNTAGAAKHQAVALRVGSDLSAFYRCDILAYQDSLYVHSNRQYFVQCLIAGTVDFIFGNAAAVLQNCDIHARRPGSGQKNMVTAQGRSDPNQNTGIVIQKCRIGATSDLRPVQKSFPTYLGRPWKEYSRTVIMQSSITDVINSAGWHEWNGNFALNTLFYGEYQNTGAGAGTSGRVKWKGFKVITSATEAQAYTPGRFIAGGSWLSSTGFPFSLGL

SEQ ID NO: 6244 - protein, 579 aa, Arabidopsis thaliana
  misc_feature (1)..(579): useful for making plants with modified plant phenotypes as described in USSN 12/139,269
  misc_feature (1)..(579): Public GI no. 29602797
  misc_feature (1)..(579): Utility: Useful for delaying senescence
MLDSGKNVNFSKGKKKLFLTVVASVLLVAAVIGVVVGVKFRSNNSDDHADIQAITSAAHAIVKSACENTLHPELCYSTIASVSDFSKKVTSQKDVIELSLNITCRAVQHNFFKVEKLIKTRKGLKPREKVALHDCLETIDETLDELHTAIKDLELYPNKKSLKAHADGLKTLISSAITNQETCLDGFSHDDADKKVRKALLKGQKHVEKMCSNALAMICNMTDTDIANEQKLKGTTTNRKLREDNSEWPEWLPAGDRRLLQSSTVRPDVVVAADGSGNFKTVSEAVAKAPEKSSKRYVIRIKAGVYRENVDVPKKKTNIMFMGDGRSNTIITGSRNVKDGSTTFHSATVAAVGEKFLARDITFQNTAGAAKHQAVALRVGSDLSAFYRCDILAYQDSLYVHSNRQYFVQCLIAGTVDFIFGNAAAVLQDCDIHARRPGSGQKNMVTAQGRSDPNQNTGIVIQKCRIGATSDLRPVQKSFPMYLGRPWKEYSRTVIMQSSITDVINSAGWHEWNGNFALNTLFYGEYQNTGAGAGTSGRVKWKGFKVITSATEAQAYTPGRFIAGGSWLSSTGFPFSLGL

SEQ ID NO: 6245 - protein, 584 aa, Arabidopsis thaliana
  misc_feature (1)..(584): useful for making plants with modified plant phenotypes as described in USSN 12/139,269
  misc_feature (1)..(584): Public GI no. 54303968
  misc_feature (1)..(584): Utility: Useful for delaying senescence
MNKIKQSLTRISNSNKKKLFFSLFTALLITASIIAISASVTSSQKTKTKNNIVSSSLSLSHHSHTIIKTACTTTLYPDLCFSAISSEPNITHKINNHKDVISLSLNITTRAVEHNFFTVENLLRRKNLSEREKIALHDCLETIDDTLDELKEAQRDLVLYPNKKTLYQHADDLKTLISAAITNQVTCLDGFSHDGADKQVRKVLEQGQVHVEHMCSNALAMTKNMTDKDIAKFEENNNKKNRKLLEEENGVNWPEWISAGDRRLLQGAAVKADVVVAADGSGNFKTVSEAVAGAPLKSSKRYVIKIKAGVYKENVEVPKKKSNIMFLGDGKKNTIITASRNVVDGSTTFHSATVAVVGGNFLARDITFQNTAGPSKHQAVALRVGGDLSAFYNCDIIAYQDTLYVHNNRQFFVNCFISGTVDFIFGNSAVVFQNCDIHARKPDSGQKNMVTAQGRVDPNQNTGIVIQKCRIGATKDLEGLKGTFPTYLGRPWKEYSRTVIMQSSISDVIDPIGWHEWNGNFALNTLVYREYQNTGPGAGTSKRVNWKGFKVITSASEAQTFTPGNFIGGSTWLGSTGFPFSLGL

SEQ ID NO: 6246 - protein, 576 aa, Arabidopsis thaliana
  misc_feature (1)..(576): useful for making plants with modified plant phenotypes as described in USSN 12/139,269
  misc_feature (1)..(576): Public GI no. 6689892
  misc_feature (1)..(576): Utility: Useful for delaying senescence
MLDSGKQIDFSKRKKKIYLAIVASVLLVAAVIGVVAGVKSRSNNSDDDADIMAISSSAHAIVKSACSNTLHPELCYSAIVNVTDFSKKVTSQKDVIELSLNITVKAVRRNYYAVKELIKTRKGLTPREKVALHDCLETMDETLDELHTAVADLELYPNKKSLKEHAEDLKTLISSAITNQETCLDGFSHDEADKKVRKVLLKGQKHVEKMCSNALAMICNMTNTDIANEMKLSGSRKLVEDNGEWPEWLSAGDRRLLQSSTVTPDVVVAADGSGDYKTVSEAVAKAPEKSSKRYVIRIKAGVYRENVDVPKKKTNIMFMGDGRSNTIITASRNVQDGSTTFHSATVAAVGEKFLARDITFQNTAGASKHQAVALRVGSDLSAFYKCDILAYQDTLYVHSNRQFFVQCLVAGTVDFIFGNGAAVLQDCDIHARRPGSGQKNMVTAQGRTDPNQNTGIVIQKCRIGATSDLRPVQKSFPTYLGRPWKEYSRTVIMQSSITDVIQPAGWHEWNGNFALNTLFYGEYANTGAGAATSGRVKWKGHKVITSSTEAQAYTPGSFIAGGSWLSSTGFPFSLGL

SEQ ID NO: 6247 - DNA, 1536 bp, Arabidopsis thaliana
  misc_feature (1)..(1536): useful for making plants with modified plant phenotypes as described in USSN 12/139,269
  misc_feature (1)..(1536): Ceres CLONE ID no. 100245
  misc_feature (1)..(1536): Also known as  Ceres CDNA ID no. 23363741
aattaaccttccatcgtcatctctttcccttttttttcccactttctttgcgaatcgcgagatctcggaatcgcatccttgattttgggatactgtttttttttttttttaatcttgtttcattttcacgtgaaattcttagctgctagaactggacttgaatttcaacgagaattttggagattttttttttgtttgggtttttcctttctgttttgtgtgtttggaattagggttgtcgagcgagaatggacaagtacgagctggtgaaagacataggtgctgggaattttggagttgccaggctcatgaaggtcaaaaactctaaggaacttgttgccatgaagtacatcgagcgtggtcctaagattgatgagaatgtggcaagagagatcattaatcacagatcacttcgccatccgaatataatccggttcaaggaggtggtgttgactccaacccatcttgccattgccatggaatatgctgctggtggtgaactattcgagcgtatatgcagtgctggaagatttagtgaggatgaggcgagatatttcttccagcagcttatatcaggtgttagctattgccatgctatgcaaatatgccatagagatctgaagctcgagaatacgctcttggatggaagtcctgctccacgtctgaaaatctgtgattttggttattccaagtcctctctgctgcactctaggcccaaatcaacagttggaactccagcatatattgcacctgaggtcctttctcgaagagaatatgatggcaagatggctgatgtatggtcttgtggtgtgactctttatgtcatgctggttggagcatacccatttgaagaccaggaagaccccaagaacttcaggaaaacaatacaaaaaataatggctgtccagtacaagatcccggactacgtccatatctcacaggattgtaaaaatctcctttcccgtatatttgtcgccaattcactcaagaggatcaccattgcagaaatcaagaaacattcatggttcctaaagaatttgccaagggaactcacagagacagctcaagctgcatatttcaagaaagagaacccaaccttctcccttcagaccgttgaagagatcatgaagatagtggctgacgccaaaacaccgcctcctgtttcccgatccatcggaggttttggctggggaggaaatggggatgcagatggaaaagaggaagatgcagaagacgtggaggaggaagaggaggaggtggaagaagaggaagacgatgaggatgaatacgataagactgtaaaggaagtacacgcaagtggagaagtgagaataagttgatattttggtttttggtctgtgtaagaaagaagtcgtcgttggtttgttgaaactgaaaagtctctgttctcgtgtttgcctttacaatgctttggctaaggttttggttctggttttggagatttgtaaaatttgcagtataagatgaacaaacagagaggttgatgatgagaatgagtcctttgctacgcatggt

SEQ ID NO: 6248 - protein, 363 aa, Arabidopsis thaliana
  misc_feature (1)..(363): useful for making plants with modified plant phenotypes as described in USSN 12/139,269
  misc_feature (4)..(260): Pfam Name: Pkinase; Pfam Description: Protein kinase domain
  misc_feature (4)..(261): Pfam Name: Pkinase_Tyr; Pfam Description: Protein tyrosine kinase
  misc_feature (1)..(363): Utility: Useful for delaying senescence
  misc_feature (1)..(363): Utility: Useful for making plants sterile and for genetic confinement
  misc_feature (1)..(363): Utility: Useful for making smaller plants
  misc_feature (1)..(363): Utility: Useful for modifying fruit shape, composition and seed yield
MDKYELVKDIGAGNFGVARLMKVKNSKELVAMKYIERGPKIDENVAREIINHRSLRHPNIIRFKEVVLTPTHLAIAMEYAAGGELFERICSAGRFSEDEARYFFQQLISGVSYCHAMQICHRDLKLENTLLDGSPAPRLKICDFGYSKSSLLHSRPKSTVGTPAYIAPEVLSRREYDGKMADVWSCGVTLYVMLVGAYPFEDQEDPKNFRKTIQKIMAVQYKIPDYVHISQDCKNLLSRIFVANSLKRITIAEIKKHSWFLKNLPRELTETAQAAYFKKENPTFSLQTVEEIMKIVADAKTPPPVSRSIGGFGWGGNGDADGKEEDAEDVEEEEEEVEEEEDDEDEYDKTVKEVHASGEVRIS

SEQ ID NO: 6249 - protein, 339 aa, Brassica napus
  misc_feature (1)..(339): useful for making plants with modified plant phenotypes as described in USSN 12/139,269
  misc_feature (1)..(339): Ceres CLONE ID no. 1099630
  misc_feature (1)..(339): Utility: Useful for delaying senescence
  misc_feature (1)..(339): Utility: Useful for making plants sterile and for genetic confinement
  misc_feature (1)..(339): Utility: Useful for making smaller plants
  misc_feature (1)..(339): Utility: Useful for modifying fruit shape, composition and seed yield
MKVKDSKELVAMKYIERGPKIDENVAREIYNHRSLRHPNIIRFKEVVLTPTHLAIAMEYAAGGELFERICGAGRFSEDEARYFFQQLISGVSYCHAMQICHRDLKLENTLLDGSPAPRLKICDFGYSKSSLLHSRPKSTVGTPAYIAPEVLSRREYDGKMADVWSCGVTLYVMLVGAYPFEDQEDPKNFRKTIQKIMAVQYKIPDYVHISQDCKHLLSRIFVANSLKRITIAEIKKHPWFTKNLPRELTETAQAAYFKKENPTFSAQTAEEIMKIVDDAKTPPPVSRSIGGFGWGGEGDLEGKEEEEVDEEEVEEEEDEEDEYDKTVKEVHASGEVRIS

SEQ ID NO: 6250 - protein, 341 aa, Arabidopsis thaliana
  misc_feature (1)..(341): useful for making plants with modified plant phenotypes as described in USSN 12/139,269
  misc_feature (1)..(341): Ceres CLONE ID no. 95559
  misc_feature (1)..(341): Utility: Useful for delaying senescence
  misc_feature (1)..(341): Utility: Useful for making plants sterile and for genetic confinement
  misc_feature (1)..(341): Utility: Useful for making smaller plants
  misc_feature (1)..(341): Utility: Useful for modifying fruit shape, composition and seed yield
MRVKNSKELVAMKYIERGPKIDENVAREIINHRSLRHPNIIRFKEVVLTPTHIAIAMEYAAGGELFERICSAGRFSEDEARYFFQQLISGVSYCHAMQICHRDLKLENTLLDGSPAPRLKICDFGYSKSSLLHSMPKSTVGTPAYIAPEVLSRGEYDGKMADVWSCGVTLYVMLVGAYPFEDQEDPKNFKKTIQRIMAVKYKIPDYVHISQDCKHLLSRIFVTNSNKRITIADIKKHPWFLKNLPRELTEIAQAAYFRKENPTFSLQSVEEIMKIVEEAKTPARVSRSIGAFGWGGGEDAEGKEEDAEEEVEEVEEEEDEEDEYDKTVKQVHASMGEVRVS

SEQ ID NO: 6251 - protein, 341 aa, Arabidopsis thaliana
  misc_feature (1)..(341): useful for making plants with modified plant phenotypes as described in USSN 12/139,269
  misc_feature (1)..(341): Ceres CLONE ID no. 260333
  misc_feature (1)..(341): Utility: Useful for delaying senescence
  misc_feature (1)..(341): Utility: Useful for making plants sterile and for genetic confinement
  misc_feature (1)..(341): Utility: Useful for making smaller plants
  misc_feature (1)..(341): Utility: Useful for modifying fruit shape, composition and seed yield
MRVKNSKELVAMKYIERGPKIDENVAREIINHRSLRHPNIIRFKEVVLTPTHIAIAMEYAAGGELFERICSAGRFSEDEARYFFQQLISGVSYCHAMQICHRDLKLENTLLDGSPAPRLKICDFGYSKSSLLHSMPKSTVGTPAYIAPEVLSRGEYDGKMADVWSCGVTLYVMLVGAYPFEDQEDPKNFKKTIQRIMAVKYKIPDYVHISQDCKHLLSRIFVTNSNKRITIGDIKKHPWFLKNLPRELTEIAQAAYFRKENPTFSLQSVEEIMKIVEEAKTPARVSRSIGAFGWGGGEDAEGKEEDAEEEVEEVEEEEDEEDEYDKTVKQVHASMGEVRVS

SEQ ID NO: 6252 - protein, 331 aa, Glycine max
  misc_feature (1)..(331): useful for making plants with modified plant phenotypes as described in USSN 12/139,269
  misc_feature (1)..(331): Ceres CLONE ID no. 591143
  misc_feature (1)..(331): Utility: Useful for delaying senescence
  misc_feature (1)..(331): Utility: Useful for making plants sterile and for genetic confinement
  misc_feature (1)..(331): Utility: Useful for making smaller plants
  misc_feature (1)..(331): Utility: Useful for modifying fruit shape, composition and seed yield
MRNKETKELVAMKYIERGQKIDENVAREIINHRSLRHPNIIRFKEVVLTPTHLAIVMEYAAGGELFERICNAGRFSEDEARYFFQQLISGVHYCHAMQICHRDLKLENTLLDGSPAPRLKICDFGYSKSSLLHSRPKSTVGTPAYIAPEVLSRREYDGKLADVWSCGVTLYVMLVGAYPFEDQDDPRNFRKTIQRIMAVQYKIPDYVHISQDCRHLLSRIFVANPLRRISLKEIKSHPWFLKNLPRELTESAQAVYYQRGNPSFSIQSVEEIMKIVGEARDPPPVSRPVKGFGWDGEEDEGEEDVEEEEDEEDEYDKRVKEVHASGEFQIS

SEQ ID NO: 6253 - protein, 352 aa, Glycine max
  misc_feature (1)..(352): useful for making plants with modified plant phenotypes as described in USSN 12/139,269
  misc_feature (1)..(352): Ceres CLONE ID no. 623826
  misc_feature (1)..(352): Utility: Useful for delaying senescence
  misc_feature (1)..(352): Utility: Useful for making plants sterile and for genetic confinement
  misc_feature (1)..(352): Utility: Useful for making smaller plants
  misc_feature (1)..(352): Utility: Useful for modifying fruit shape, composition and seed yield
MEKYELVKDIGSGNFGVARLMRHKDTKELVAMKYIERGHKIDENVAREIINHRSLRHPNIIRFKEVVLTPTHLGIVMEYAAGGELFERICSAGRFSEDEARYFFQQLISGVSYCHSMQICHRDLKLENTLLDGSPAPRLKICDFGYSKSSLLHSRPKSTVGTPAYIAPEVLSRREYDGKLADVWSCGVTLYVMLVGAYPFEDQEDPKNFRKTINRIMAVQYKIPDYVHISQDCRHLLSRIFVANPARRITIKEIKSHPWFVKNLPRELTEVAQAAYYRKENPTFSLQSIEDIMNIVEEAKAPPPASRSIGGFGWGGEEEEEDETKEAVAETEEDEYEKRVKEAQASGEFHVS

SEQ ID NO: 6254 - protein, 329 aa, Glycine max
  misc_feature (1)..(329): useful for making plants with modified plant phenotypes as described in USSN 12/139,269
  misc_feature (1)..(329): Ceres CLONE ID no. 1100861
  misc_feature (1)..(329): Utility: Useful for delaying senescence
  misc_feature (1)..(329): Utility: Useful for making plants sterile and for genetic confinement
  misc_feature (1)..(329): Utility: Useful for making smaller plants
  misc_feature (1)..(329): Utility: Useful for modifying fruit shape, composition and seed yield
MRNKVTKELVAMKYIERGPKIDENVAREIMNHRSLRHPNIIRYKEVVLTPTHLAIVMEYAAGGELFERICSAGRFSEDEARYFFQQLISGVHFCHTMQICHRDLKLENTLLDGSPAPRLKICDFGYSKSSLLHSRPKSTVGTPAYIAPEVLSRREYDGKLADVWSCAVTLYVMLVGAYPFEDQDDPRNFRKTIQRIMAVQYKIPDYVHISQDCRHLLSRIFVANPLRRITIKEIKNHPWFLRNLPRELTESAQAIYYQRDSPNFHLQSVDEIMKIVGEARNPPPVSRALKGFGWEGEEDLDEEVEEEEDEDEYDKRVKEVHASGEFQIS

SEQ ID NO: 6255 - protein, 356 aa, Zea mays
  misc_feature (1)..(356): useful for making plants with modified plant phenotypes as described in USSN 12/139,269
  misc_feature (1)..(356): Ceres CLONE ID no. 288489
  misc_feature (1)..(356): Utility: Useful for delaying senescence
  misc_feature (1)..(356): Utility: Useful for making plants sterile and for genetic confinement
  misc_feature (1)..(356): Utility: Useful for making smaller plants
  misc_feature (1)..(356): Utility: Useful for modifying fruit shape, composition and seed yield
MEKYELLKDIGAGNFGVARLMRNKETKELVAMKYIPRGQKIDENVAREIINHRSLRHPNIIRFKEVVLTPTHLAIVMEYAAGGELFDRICNAGRFSEDEARYFFQQLICGVSYCHSMQICHRDLKLENTLLDGSPAPRLKICDFGYSKSSLLHSKPKSTVGTPAYIAPEVLSRREYDGKTADVWSCGVTLYVMLVGGYPFEDPDDPKNFRKTIGRIMSIQYKIPEYVHVSQDCKELLSRIFVANSAKRITIREIRNHPWFLKNLPRELTEAAQAMYYKKDNSAPTYSVQSVEEIMKIVEKARTPPPSSTPVAGFGWAEEDEQEDSKEPDEEHEDGEDEYEKQVKQVHASGEFHLSC

SEQ ID NO: 6256 - protein, 356 aa, Zea mays; identical to SEQ ID NO: 6255
  misc_feature (1)..(356): useful for making plants with modified plant phenotypes as described in USSN 12/139,269
  misc_feature (1)..(356): Ceres CLONE ID no. 240283
  misc_feature (1)..(356): Utility: Useful for delaying senescence
  misc_feature (1)..(356): Utility: Useful for making plants sterile and for genetic confinement
  misc_feature (1)..(356): Utility: Useful for making smaller plants
  misc_feature (1)..(356): Utility: Useful for modifying fruit shape, composition and seed yield

SEQ ID NO: 6257 - protein, 322 aa, Arabidopsis thaliana
  misc_feature (1)..(322): useful for making plants with modified plant phenotypes as described in USSN 12/139,269
  misc_feature (1)..(322): Ceres CLONE ID no. 31041
  misc_feature (1)..(322): Utility: Useful for delaying senescence
  misc_feature (1)..(322): Utility: Useful for making plants sterile and for genetic confinement
  misc_feature (1)..(322): Utility: Useful for making smaller plants
  misc_feature (1)..(322): Utility: Useful for modifying fruit shape, composition and seed yield
MKYIERGRKIDENVAREIINHRSLKHPNIIRFKEVILTPTHLAIVMEYASGGELFDRICTAGRFSEAEARYFFQQLICGVDYCHSLQICHRDLKLENTLLDGSPAPLLKICDFGYSKSSILHSRPKSTVGTPAYIAPEVLSRREYDGKHADVWSCGVTLYVMLVGAYPFEDPNDPKNFRKTIQRIMAVQYKIPDYVHISQECKHLLSRIFVTNSAKRITLKEIKNHPWYLKNLPKELLESAQAAYYKRDTSFSLQSVEDIMKIVGEARNPAPSTSAVKSSGSGADEEEEEDVEAEVEEEEDDEDEYEKHVKEAQSCQESDKA

SEQ ID NO: 6258 - protein, 327 aa, Arabidopsis thaliana
  misc_feature (1)..(327): useful for making plants with modified plant phenotypes as described in USSN 12/139,269
  misc_feature (1)..(327): Ceres CLONE ID no. 39888
  misc_feature (1)..(327): Utility: Useful for delaying senescence
  misc_feature (1)..(327): Utility: Useful for making plants sterile and for genetic confinement
  misc_feature (1)..(327): Utility: Useful for making smaller plants
  misc_feature (1)..(327): Utility: Useful for modifying fruit shape, composition and seed yield
MKYIERGRKIDENVAREIINHRSLRHPNIIRFKEVILTPTHLAIVMEYASGGELFERICNAGRFSEAEARYFFQQLICGVDYCHSLQICHRDLKLENTLLDGSPAPLLKICDFGYSKSSLLHSRPKSTVGTPAYIAPEVLSRREYDGKHADVWSCGVTLYVMLVGGYPFEDPDDPRNFRKTIQRIMAVQYKIPDYVHISQECRHLLSRIFVTNSAKRITLKEIKKHPWYLKNLPKELTEPAQAAYYKRETPSFSLQSVEDIMKIVGEARNPAPSSNAVKGFDDDEEDVEDEVEEEEEEEEEEEEEEEEDEYEKHVKEAHSCQEPPKA

SEQ ID NO: 6259 - protein, 344 aa, Zea mays
  misc_feature (1)..(344): useful for making plants with modified plant phenotypes as described in USSN 12/139,269
  misc_feature (1)..(344): Ceres CLONE ID no. 237589
  misc_feature (1)..(344): Utility: Useful for delaying senescence
  misc_feature (1)..(344): Utility: Useful for making plants sterile and for genetic confinement
  misc_feature (1)..(344): Utility: Useful for making smaller plants
  misc_feature (1)..(344): Utility: Useful for modifying fruit shape, composition and seed yield
MRNKDTKELVAMKYIPRGLKIDENVAREIINHRSLRHPNIIRFKEVVLTPTHLAIVMEYAAGGELFDRICSAGRFSEDEARYFFQQLICGVSYCHFMQICHRDLKLENTLLDGSPAPRLKICDFGYSKSSLLHSKPKSTVGTPAYIAPEVLSRREYDGKMADVWSCGVTLYVMLVGAYPFEDPDDPKNFRKTIGRIVSIQYQIPEYVHLSQDCRQLLARIFVANPAKRITIREIRNHPWFLKNLPRELTEAAQAKYYKKDNGAPTFSDQTVEEIMKIVEEARTPPQSPAPVAGFGWAEEEEQEDGKKPEDDEQDGEDEQYDGEDEYDKQVKQVHASGDFRHLIK

SEQ ID NO: 6260 - protein, 339 aa, Glycine max
  misc_feature (1)..(339): useful for making plants with modified plant phenotypes as described in USSN 12/139,269
  misc_feature (1)..(339): Ceres CLONE ID no. 515236
  misc_feature (1)..(339): Utility: Useful for delaying senescence
  misc_feature (1)..(339): Utility: Useful for making plants sterile and for genetic confinement
  misc_feature (1)..(339): Utility: Useful for making smaller plants
  misc_feature (1)..(339): Utility: Useful for modifying fruit shape, composition and seed yield
MDERYETLKELGSGNFGVARLAKDKETGELVAIKYIERGKKIDANVQREIVNHRSLRHPNIIRFKEVFLTPTHLAIVLEYAAGGELFERICNAGRLSEDEARFFFQQLISGVSYCHSMQICHRDLKLENTLLDGNPAPRLKICDFGFSKSALLHSQPKSTVGTPAYIAPEVLSRKEYDGKVADVWSCGVTLYVMLVGAYPFEDPEDPKNFRKSIGRIMSVQYAIPDYVRVSKECRHLISRIFVANPAKRINISEIKQHLWFRKNLPREIIEAERRGYEETQKDQPSQSVEEIMQIIQEARTKIHTGEQAGTGTSDVVRGDEANEEVDINDHFAKYLTLD

SEQ ID NO: 6261 - protein, 216 aa, Zea mays
  misc_feature (1)..(216): useful for making plants with modified plant phenotypes as described in USSN 12/139,269
  misc_feature (1)..(216): Ceres CLONE ID no. 679007
  misc_feature (1)..(216): Utility: Useful for delaying senescence
  misc_feature (1)..(216): Utility: Useful for making plants sterile and for genetic confinement
  misc_feature (1)..(216): Utility: Useful for making smaller plants
  misc_feature (1)..(216): Utility: Useful for modifying fruit shape, composition and seed yield
MEICHRDLKLENTLLDGSPTPRVKICDFGYSKSALLHSKPKSTVGTPAYIAPEVLSRKEYDGKVADVWSCGVTLYVMLVGSYPFEDPEDPRNFRKTISRILGVQYSIPDYVRVSSDCRRLLSQIFVADPSKRITIPEIKHHPWFLKNLPREISEREKANYKDADAAEPAQAVDEIMRIVEEAKTPGDMSKVVDPALLAEMAELESDEEEADADDTY

SEQ ID NO: 6262 - DNA, 611 bp, Arabidopsis thaliana
  misc_feature (1)..(611): useful for making plants with modified plant phenotypes as described in USSN 12/139,269
  misc_feature (1)..(611): Ceres CLONE ID no. 101798
  misc_feature (1)..(611): Also known as  Ceres CDNA ID no. 23372982
atatccaacaaaaaaacataagctaagaaaacgaaactcaactaattttgttatcacccaaaaagaagttcaaacacaatggctttcgctttgaggttcttcacatgccttgttttaacggtgtgcatagttgcatcagtcgatgctgcaatctcatgtggcacagtggcaggtagcttggctccatgtgcaacctatctatcaaaaggtgggttggtgccaccttcatgttgtgcaggagtcaaaactttgaacagtatggctaaaaccacaccagaccgccaacaagcttgcagatgcatccagtccactgcgaagagcatttctggtctcaacccaagtctagcctctggccttcctggaaagtgcggtgttagcattccatatccaatctccatgagcactaactgcaacaacatcaagtgaaatggaagcttacgtcgccgttttggcgttaagagtatggtttaccagaagtactagaataaaatacggctatatatcttagctgatattaccatgtatttgtttttgtctcaatgctttgtcttattttcatatcatatgttgtattgatgtgctaaaactatgataatagtaccttattagtc

SEQ ID NO: 6263 - protein, 115 aa, Arabidopsis thaliana
  misc_feature (1)..(115): useful for making plants with modified plant phenotypes as described in USSN 12/139,269
  misc_feature (27)..(111): Pfam Name: Tryp_alpha_amyl; Pfam Description: Protease inhibitor/seed storage/LTP family
  misc_feature (1)..(115): Utility: Useful for delaying senescence
  misc_feature (1)..(115): Utility: Useful for making plants sterile and for genetic confinement
  misc_feature (1)..(115): Utility: Useful for making smaller plants
MAFALRFFTCLVLTVCIVASVDAAISCGTVAGSLAPCATYLSKGGLVPPSCCAGVKTLNSMAKTTPDRQQACRCIQSTAKSISGLNPSLASGLPGKCGVSIPYPISMSTNCNNIK

SEQ ID NO: 6264 - protein, 96 aa, Arabidopsis thaliana
  misc_feature (1)..(96): useful for making plants with modified plant phenotypes as described in USSN 12/139,269
  misc_feature (1)..(96): Ceres CLONE ID no. 43057
  misc_feature (1)..(96): Utility: Useful for delaying senescence
  misc_feature (1)..(96): Utility: Useful for making plants sterile and for genetic confinement
  misc_feature (1)..(96): Utility: Useful for making smaller plants
  misc_feature (86)..(86): Xaa is any aa, unknown or other
MAFALRFFTCFVLTVFIVASVDAAITCGTVASSLSPCLGYLSKGGVVPPPCCAGVKKLNGMAQTTPDRQQACRCLQSAAKGVNPSXSLWPSWKVRC

SEQ ID NO: 6265 - protein, 112 aa, Brassica napus
  misc_feature (1)..(112): useful for making plants with modified plant phenotypes as described in USSN 12/139,269
  misc_feature (1)..(112): Ceres CLONE ID no. 1084610
  misc_feature (1)..(112): Utility: Useful for delaying senescence
  misc_feature (1)..(112): Utility: Useful for making plants sterile and for genetic confinement
  misc_feature (1)..(112): Utility: Useful for making smaller plants
  misc_feature (35)..(35): Xaa is any aa, unknown or other
  misc_feature (105)..(105): Xaa is any aa, unknown or other
MASALSFFTCLVLTVCIVASVDAAISCGTVTSNLXPCAGYLMKGGPVPASCCAGVSKLNSMAKTTPDRQQACKCLKTAAKSVNPSLASSLPGKCGVSIPYPISMXTNCNTVK

SEQ ID NO: 6266 - protein, 130 aa, Brassica napus
  misc_feature (1)..(130): useful for making plants with modified plant phenotypes as described in USSN 12/139,269
  misc_feature (1)..(130): Ceres CLONE ID no. 1256733
  misc_feature (1)..(130): Utility: Useful for delaying senescence
  misc_feature (1)..(130): Utility: Useful for making plants sterile and for genetic confinement
  misc_feature (1)..(130): Utility: Useful for making smaller plants
  misc_feature (7)..(7): Xaa is any aa, unknown or other
  misc_feature (9)..(9): Xaa is any aa, unknown or other
MLSCIFXMXLDKREKQKTMASALSFFTCLVLTVCIVASVDAAISCGTVTSNLAPCAVYLMKGGPVPAPCCAGVSKLNSMAKTTPDRQQACKCLKTAAKNVNPSLASSLPGKCGVSIPYPISMSTNCDTVK

SEQ ID NO: 6267 - protein, 113 aa, Parthenium argentatum
  misc_feature (1)..(113): useful for making plants with modified plant phenotypes as described in USSN 12/139,269
  misc_feature (1)..(113): Ceres CLONE ID no. 1606591
  misc_feature (1)..(113): Utility: Useful for delaying senescence
  misc_feature (1)..(113): Utility: Useful for making plants sterile and for genetic confinement
  misc_feature (1)..(113): Utility: Useful for making smaller plants
MAMMVLCAIVTCMVVVAPYAEAISCGQVSGSLAPCIGYLTRGGGVPSACCNGVRGLNNAARTTPDRQTACNCLKSAYKSIRGINGGNAASLPGKCGVSIPYKISPNTDCTKVR

SEQ ID NO: 6268 - protein, 113 aa, Parthenium argentatum; identical to SEQ ID NO: 6267
  misc_feature (1)..(113): useful for making plants with modified plant phenotypes as described in USSN 12/139,269
  misc_feature (1)..(113): Ceres CLONE ID no. 1610037
  misc_feature (1)..(113): Utility: Useful for delaying senescence
  misc_feature (1)..(113): Utility: Useful for making plants sterile and for genetic confinement
  misc_feature (1)..(113): Utility: Useful for making smaller plants

SEQ ID NO: 6269 - protein, 118 aa, Glycine max
  misc_feature (1)..(118): useful for making plants with modified plant phenotypes as described in USSN 12/139,269
  misc_feature (1)..(118): Ceres CLONE ID no. 473005
  misc_feature (1)..(118): Utility: Useful for delaying senescence
  misc_feature (1)..(118): Utility: Useful for making plants sterile and for genetic confinement
  misc_feature (1)..(118): Utility: Useful for making smaller plants
MASLKVAFLAAVLCMVVVSAPMAHAAITCGQVTNSLINCIGYLQNGGTPPSGCCNGVKSLNAAAKTTADRQTACNCLKSAASQISGFKANNAASLPGKCGVSIPYKISTSTNCATIKV

SEQ ID NO: 6270 - protein, 118 aa, Glycine max; identical to SEQ ID NO: 6269
  misc_feature (1)..(118): useful for making plants with modified plant phenotypes as described in USSN 12/139,269
  misc_feature (1)..(118): Ceres CLONE ID no. 745591
  misc_feature (1)..(118): Utility: Useful for delaying senescence
  misc_feature (1)..(118): Utility: Useful for making plants sterile and for genetic confinement
  misc_feature (1)..(118): Utility: Useful for making smaller plants

SEQ ID NO: 6271 - protein, 115 aa, Triticum aestivum
  misc_feature (1)..(115): useful for making plants with modified plant phenotypes as described in USSN 12/139,269
  misc_feature (1)..(115): Ceres CLONE ID no. 618028
  misc_feature (1)..(115): Utility: Useful for delaying senescence
  misc_feature (1)..(115): Utility: Useful for making plants sterile and for genetic confinement
  misc_feature (1)..(115): Utility: Useful for making smaller plants
MARTAATKLVLVALVAAMLLVASDAAISCGQVNSALASCVSYAKGSGASPPGACCSGVRRLAGLARSTADKQAACRCIKSAAGGLNPGKAASIPSKCGVSIPYSISASVDCSKIH

SEQ ID NO: 6272 - protein, 101 aa, Triticum aestivum
  misc_feature (1)..(101): useful for making plants with modified plant phenotypes as described in USSN 12/139,269
  misc_feature (1)..(101): Ceres CLONE ID no. 770864
  misc_feature (1)..(101): Utility: Useful for delaying senescence
  misc_feature (1)..(101): Utility: Useful for making plants sterile and for genetic confinement
  misc_feature (1)..(101): Utility: Useful for making smaller plants
MAGREASAALSCGQVDSKLAPCVAYVTGRASSISKECCSGVQGLNGLARSSPDRKIACRCLKSLATSIKSINMGKVSGVPGKCGVSVPFPISMSTNCNNVN

SEQ ID NO: 6273 - protein, 102 aa, Triticum aestivum
  misc_feature (1)..(102): useful for making plants with modified plant phenotypes as described in USSN 12/139,269
  misc_feature (1)..(102): Ceres CLONE ID no. 1017382
  misc_feature (1)..(102): Utility: Useful for delaying senescence
  misc_feature (1)..(102): Utility: Useful for making plants sterile and for genetic confinement
  misc_feature (1)..(102): Utility: Useful for making smaller plants
MMAGREASAALSCGQVDSKLAPCVAYVTGRASSISKECCSGVQGLNGLARSSPDRKIACRCLKSLATSIKSINMGKVSGVPGKCGVSVPFPISMSTNCNNVN

SEQ ID NO: 6274 - protein, 101 aa, Triticum aestivum
  misc_feature (1)..(101): useful for making plants with modified plant phenotypes as described in USSN 12/139,269
  misc_feature (1)..(101): Ceres CLONE ID no. 775154
  misc_feature (1)..(101): Utility: Useful for delaying senescence
  misc_feature (1)..(101): Utility: Useful for making plants sterile and for genetic confinement
  misc_feature (1)..(101): Utility: Useful for making smaller plants
  misc_feature (17)..(17): Xaa is any aa, unknown or other
  misc_feature (44)..(44): Xaa is any aa, unknown or other
  misc_feature (60)..(60): Xaa is any aa, unknown or other
  misc_feature (76)..(76): Xaa is any aa, unknown or other
MMAGREATALSCGQVDXKLAPCVSYVTGKAPSISKECCSGVQGXNGLARSSPDRKIACRXLKSLATSIKSINMDKXSGVPGKCGVSVPFPISMSTNCNNVN

SEQ ID NO: 6275 - protein, 105 aa, Glycine max
  misc_feature (1)..(105): useful for making plants with modified plant phenotypes as described in USSN 12/139,269
  misc_feature (1)..(105): Ceres CLONE ID no. 589684
  misc_feature (1)..(105): Utility: Useful for delaying senescence
  misc_feature (1)..(105): Utility: Useful for making plants sterile and for genetic confinement
  misc_feature (1)..(105): Utility: Useful for making smaller plants
MVVVITAPMTNAITCGEVARSLSPCINYLRSRRGGSPEAECCRGVTSLNRAASNTADRRTACNCLKSVAASISGLNANNAASLPGRCRVRVPYRISTSTNCNRIR

SEQ ID NO: 6276 - protein, 122 aa, Zea mays
  misc_feature (1)..(122): useful for making plants with modified plant phenotypes as described in USSN 12/139,269
  misc_feature (1)..(122): Ceres CLONE ID no. 325450
  misc_feature (1)..(122): Utility: Useful for delaying senescence
  misc_feature (1)..(122): Utility: Useful for making plants sterile and for genetic confinement
  misc_feature (1)..(122): Utility: Useful for making smaller plants
MAAVLNSRKTPQVVAVLVAAALLASSASAAITCGQVGSSLAPCIPYATGRASALPASCCSGVKSLNSAARTSADRQAACRCLKSLANSVKSVNMGTVATIPGKCGVSVGFPISMSTDCNKIS

SEQ ID NO: 6277 - protein, 118 aa, Glycine max
  misc_feature (1)..(118): useful for making plants with modified plant phenotypes as described in USSN 12/139,269
  misc_feature (1)..(118): Ceres CLONE ID no. 481690
  misc_feature (1)..(118): Utility: Useful for delaying senescence
  misc_feature (1)..(118): Utility: Useful for making plants sterile and for genetic confinement
  misc_feature (1)..(118): Utility: Useful for making smaller plants
MKVTSCMVAVLMVSFGHIIPLAEAEIPCGRVQITVAPCIGYLRGPGGGVPAACCNGVRSINKEAKTTPDRQGVCRCLKTTALSLPGLNLATLAALPSKCGVNLPYKISPTIDCNTVKH

SEQ ID NO: 6278 - DNA, 1363 bp, Arabidopsis thaliana
  misc_feature (1)..(1363): useful for making plants with modified plant phenotypes as described in USSN 12/139,269
  misc_feature (1)..(1363): Ceres CLONE ID no. 38370
  misc_feature (1)..(1363): Also known as  Ceres CDNA ID no. 23377443
aaatacacctaacttgtttagtacacaacagcaacatcaaactctaataaacccaagttggtgtatactataatggtgatggctggtgcttcttctttggatgagatcagacaggctcagagagctgatggacctgcaggcatcttggctattggcactgctaaccctgagaaccatgtgcttcaggcggagtatcctgactactacttccgcatcaccaacagtgaacacatgaccgacctcaaggagaagttcaagcgcatgtgcgacaagtcgacaattcggaaacgtcacatgcatctgacggaggaattcctcaaggaaaacccacacatgtgtgcttacatggctccttctctggacaccagacaggacatcgtggtggtcgaagtccctaagctaggcaaagaagcggcagtgaaggccatcaaggagtggggccagcccaagtcaaagatcactcatgtcgtcttctgcactacctccggcgtcgacatgcctggtgctgactaccagctcaccaagcttcttggtctccgtccttccgtcaagcgtctcatgatgtaccagcaaggttgcttcgccggcggtactgtcctccgtatcgctaaggatctcgccgagaacaaccgtggagcacgtgtcctcgttgtctgctctgagatcacagccgttaccttccgtggtccctctgacacccaccttgactccctcgtcggtcaggctcttttcagtgatggcgccgccgcactcattgtggggtcggaccctgacacatctgtcggagagaaacccatctttgagatggtgtctgccgctcagaccatccttccagactctgatggtgccatagacggacatttgagggaagttggtctcaccttccatctcctcaaggatgttcccggcctcatctccaagaacattgtgaagagtctagacgaagcgtttaaacctttggggataagtgactggaactccctcttctggatagcccaccctggaggtccagcgatcctagaccaggtggagataaagctaggactaaaggaagagaagatgagggcgacacgtcacgtgttgagcgagtatggaaacatgtcgagcgcgtgcgttctcttcatactagacgagatgaggaggaagtcagctaaggatggtgtggccacgacaggagaagggttggagtggggtgtcttgtttggtttcggaccaggtctcactgttgagacagtcgtcttgcacagcgttcctctctaaacagaacgcttgccttctatctgcctacctacctacgcaaaactttaatcctgtcttatgttttatataatataatcattatatgtttacgcaataattaagg

SEQ ID NO: 6279 - protein, 395 aa, Arabidopsis thaliana
  misc_feature (1)..(395): useful for making plants with modified plant phenotypes as described in USSN 12/139,269
  misc_feature (7)..(233): Pfam Name: Chal_sti_synt_N; Pfam Description: Chalcone and stilbene synthases, N-terminal domain
  misc_feature (244)..(394): Pfam Name: Chal_sti_synt_C; Pfam Description: Chalcone and stilbene synthases, C-terminal domain
  misc_feature (7)..(233): Pfam Name: Chal_sti_synt_N; Pfam Description: Chalcone and stilbene synthases, N-terminal domain
  misc_feature (244)..(394): Pfam Name: Chal_sti_synt_C; Pfam Description: Chalcone and stilbene synthases, C-terminal domain
  misc_feature (1)..(395): Utility: Useful for increasing chlorophyll and photosynthetic capacity
  misc_feature (1)..(395): Utility: Useful for making ornamental plants with modified flowers
  misc_feature (1)..(395): Utility: Useful for making plants sterile and for genetic confinement
  misc_feature (1)..(395): Utility: Useful for making smaller plants
  misc_feature (1)..(395): Utility: Useful for making stronger plants
  misc_feature (1)..(395): Utility: Useful for modifying fiber content in seed
MVMAGASSLDEIRQAQRADGPAGILAIGTANPENHVLQAEYPDYYFRITNSEHMTDLKEKFKRMCDKSTIRKRHMHLTEEFLKENPHMCAYMAPSLDTRQDIVVVEVPKLGKEAAVKAIKEWGQPKSKITHVVFCTTSGVDMPGADYQLTKLLGLRPSVKRLMMYQQGCFAGGTVLRIAKDLAENNRGARVLVVCSEITAVTFRGPSDTHLDSLVGQALFSDGAAALIVGSDPDTSVGEKPIFEMVSAAQTILPDSDGAIDGHLREVGLTFHLLKDVPGLISKNIVKSLDEAFKPLGISDWNSLFWIAHPGGPAILDQVEIKLGLKEEKMRATRHVLSEYGNMSSACVLFILDEMRRKSAKDGVATTGEGLEWGVLFGFGPGLTVETVVLHSVPL

SEQ ID NO: 6280 - protein, 392 aa, Brassica napus
  misc_feature (1)..(392): useful for making plants with modified plant phenotypes as described in USSN 12/139,269
  misc_feature (1)..(392): Ceres CLONE ID no. 1091268
  misc_feature (1)..(392): Utility: Useful for increasing chlorophyll and photosynthetic capacity
  misc_feature (1)..(392): Utility: Useful for making ornamental plants with modified flowers
  misc_feature (1)..(392): Utility: Useful for making plants sterile and for genetic confinement
  misc_feature (1)..(392): Utility: Useful for making smaller plants
  misc_feature (1)..(392): Utility: Useful for making stronger plants
  misc_feature (1)..(392): Utility: Useful for modifying fiber content in seed
MGPSSLDEIRKAQRADGPAGILAIGTANPANHVLQAEYPDYYFRITNSEHMTDLKEKFKRMCDKSTIRKRHMHLTEEFLKENPNMCAYMAPSLDARQDLVVVEVPKLGKDAAVKAIKEWGQPKSKITHVVFCTTSGVDMPGADYQLTKLLGLRPSVKRLMMYQQGCFAGGTVLRLAKDLAENNRGARVLVVCSEITAVTFRGPSDTHLVSLVGQALFSDGAAALIVGSDPDVSAGEKPIFQMVSAAQTILPDSDGAIDGHLREVGLTFHLLKDVPGLISKNIEKSLDEAFKPLGISDWNSLFWIAHPGGPAILDDVEKKLGLKAEKMRATRHVLSEYGNMSSACVLFILDEMRRKSKEDGVATTGEGLEWGVLFGFGPGLTVETVVLHSVPL

SEQ ID NO: 6281 - protein, 211 aa, Parthenium argentatum
  misc_feature (1)..(211): useful for making plants with modified plant phenotypes as described in USSN 12/139,269
  misc_feature (1)..(211): Ceres CLONE ID no. 1604873
  misc_feature (1)..(211): Utility: Useful for increasing chlorophyll and photosynthetic capacity
  misc_feature (1)..(211): Utility: Useful for making ornamental plants with modified flowers
  misc_feature (1)..(211): Utility: Useful for making plants sterile and for genetic confinement
  misc_feature (1)..(211): Utility: Useful for making smaller plants
  misc_feature (1)..(211): Utility: Useful for making stronger plants
  misc_feature (1)..(211): Utility: Useful for modifying fiber content in seed
MASSIDIAAIREAQRARGPATILAIGTATPSNCVYQANYPDYYFRITKSEHMVDLKEKFKRMCDKSMIRKRYMHLTEEYLKENPNICEYMAPSLDARQDVVVVEVPKLGKEAAVKAIKEWGKPKSQITHLIFCTTSGVDMPGADYQLTKLLGLRPSVKRFMMYQQGCFAGGTVLRMAKDLAENTRAHASLLCALRSLRSRFVDRVILTLTP

SEQ ID NO: 6282 - protein, 252 aa, Triticum aestivum
  misc_feature (1)..(252): useful for making plants with modified plant phenotypes as described in USSN 12/139,269
  misc_feature (1)..(252): Ceres CLONE ID no. 615767
  misc_feature (1)..(252): Utility: Useful for increasing chlorophyll and photosynthetic capacity
  misc_feature (1)..(252): Utility: Useful for making ornamental plants with modified flowers
  misc_feature (1)..(252): Utility: Useful for making plants sterile and for genetic confinement
  misc_feature (1)..(252): Utility: Useful for making smaller plants
  misc_feature (1)..(252): Utility: Useful for making stronger plants
  misc_feature (1)..(252): Utility: Useful for modifying fiber content in seed
MASSTVCEIRRLQRADGPALVLAIGTANPPNHLSQEEYLEYYFRATKSEHLTDLKREFKSICDRTGTEKRFFHHTQELLDAHPRFFDGGHDRLEIAAAVAPDLAALAAAKAITKWGRPATDITHLIVSTNSCARAPGADLRIASLLGLRPSVVCTLLQINGCSAGSASLRLAKDIAENNRGARVLVVCVELSVAALRGPEENYPHTLISQAIFSDGAGAVIIGADTVHPLERPLFEMVSASQIVIPGTDHLP

SEQ ID NO: 6283 - protein, 369 aa, Triticum aestivum
  misc_feature (1)..(369): useful for making plants with modified plant phenotypes as described in USSN 12/139,269
  misc_feature (1)..(369): Ceres CLONE ID no. 764645
  misc_feature (1)..(369): Utility: Useful for increasing chlorophyll and photosynthetic capacity
  misc_feature (1)..(369): Utility: Useful for making ornamental plants with modified flowers
  misc_feature (1)..(369): Utility: Useful for making plants sterile and for genetic confinement
  misc_feature (1)..(369): Utility: Useful for making smaller plants
  misc_feature (1)..(369): Utility: Useful for making stronger plants
  misc_feature (1)..(369): Utility: Useful for modifying fiber content in seed
MLAIGTANPPHCVPQEDYPDYYFGVTKSDHLTDLKRTFAKLCGMTGIGRRFFHHTDELLATHPDLSLDARLDVVATAAPELAASAAANAIAEWGRPAGDITHLVVSTNAGSHAPGTDVRLVSLLGLRHDVLRTVLQLNGCASGCAALRLAKDLAENNHGARVLVACVELTITAFRGPDEADSFDTLIPQGLFGDGAGAAIVGAEPYVHERPLFEMVSASQYVIPDTEHMLTMQLGSGGIGGTIATGLPRLAAGIVEKCLLDAFGDRLAGIGGVVEWNNLFWAVHPGSSAMLDHIVRALRLAPAKLAASRTVVREYGNMLGATVIFVLDEVRRQREDPEGEGASHDEGWGVMMGFGPGFTVETMLLHAAT

SEQ ID NO: 6284 - protein, 409 aa, Zea mays
  misc_feature (1)..(409): useful for making plants with modified plant phenotypes as described in USSN 12/139,269
  misc_feature (1)..(409): Ceres CLONE ID no. 241538
  misc_feature (1)..(409): Utility: Useful for increasing chlorophyll and photosynthetic capacity
  misc_feature (1)..(409): Utility: Useful for making ornamental plants with modified flowers
  misc_feature (1)..(409): Utility: Useful for making plants sterile and for genetic confinement
  misc_feature (1)..(409): Utility: Useful for making smaller plants
  misc_feature (1)..(409): Utility: Useful for making stronger plants
  misc_feature (1)..(409): Utility: Useful for modifying fiber content in seed
MAAARPGNLSELEQKWHNGGGPACVLGVGTANPANCVRQDEYTDWYFRITKSDHLTHTKAIMRKTCEKMMVKKRYLQVNEELFSVHPEFLDPAAPSLQGKLAVVAGAMPGLVAAAAEKAIADWGRPAGDITHLVFATSSSAQLPHIDLRIAALLGLSTTVQRTVIGFHACSGSSAALRVAKYIAENNRSARVLVACADMWSVMDSYVVPNVDHRYGIIGHAFIGDGAGAVVVGSRPQEPVERPIFEMVSASQATVPGSERAVAVELTNCGLEYRLEFGDVAAEVGGNIERCLLDALSPLGIGSVGWNNLFWVVHPGGPRIMDTFTAALKLQPEKLSASRRVLREYGNITGPTLIFVLDEAIRRRQLDHEEGSCEWGLMVGLGPGFTIDVMALRACSGKSTPTPRIKSSL

SEQ ID NO: 6285 - DNA, 606 bp, Arabidopsis thaliana
  misc_feature (1)..(606): useful for making plants with modified plant phenotypes as described in USSN 12/139,269
  misc_feature (1)..(606): Ceres CLONE ID no. 1496
  misc_feature (1)..(606): Also known as  Ceres CDNA ID no. 23358648
tttctcaaacaagaaaatgcagatcttcgtgaaaaccctaacggggaagacaataaccttagaggtagaatcatcagacacaatcgacaatgtgaaagcgaagatccaagacaaggaaggaatcccaccggatcagcaacggttgatcttcgccggaaaacaattggaagatggaagaacactagctgattacaacatccagaaagagtcgacgcttcatttggttctacgtctgagaggaggtgcgaagaagaggaagaagaagacgtacacgaaacctaagaagattaagcatacgcacaagaaagtgaagctagcagttctgcagttttacaaggttgatggaagtgggaaagttcagaggttgaagaaagagtgtccttctgttagttgtggtcctggaactttcatggcgagtcatttcgataggcattattgtgggaaatgtggaactacttacgtgttcaagaaggctgatgaagagtaggttatgtctttttgcttttggaatttagattgttttttttttttaattcagatattttgagatggttttatactattgaggatggtttaattgttgcataatacattatattatctttg

SEQ ID NO: 6286 - protein, 156 aa, Arabidopsis thaliana
  misc_feature (1)..(156): useful for making plants with modified plant phenotypes as described in USSN 12/139,269
  misc_feature (1)..(74): Pfam Name: ubiquitin; Pfam Description: Ubiquitin family
  misc_feature (101)..(147): Pfam Name: Ribosomal_S27; Pfam Description: Ribosomal protein S27a
  misc_feature (1)..(156): Utility: Useful for increasing chlorophyll and photosynthetic capacity
  misc_feature (1)..(156): Utility: Useful for making ornamental plants with modified leaves
  misc_feature (1)..(156): Utility: Useful for making plants sterile and for genetic confinement
  misc_feature (1)..(156): Utility: Useful for making plants with increased biomass
  misc_feature (1)..(156): Utility: Useful for making plants with increased biomass and foliage
  misc_feature (1)..(156): Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHTHKKVKLAVLQFYKVDGSGKVQRLKKECPSVSCGPGTFMASHFDRHYCGKCGTTYVFKKADEE

SEQ ID NO: 6287 - protein, 158 aa, Glycine max
  misc_feature (1)..(158): useful for making plants with modified plant phenotypes as described in USSN 12/139,269
  misc_feature (1)..(158): Ceres CLONE ID no. 1120170
  misc_feature (1)..(158): Utility: Useful for increasing chlorophyll and photosynthetic capacity
  misc_feature (1)..(158): Utility: Useful for making ornamental plants with modified leaves
  misc_feature (1)..(158): Utility: Useful for making plants sterile and for genetic confinement
  misc_feature (1)..(158): Utility: Useful for making plants with increased biomass
  misc_feature (1)..(158): Utility: Useful for making plants with increased biomass and foliage
  misc_feature (1)..(158): Utility: Useful for making smaller plants
TPPLAYTESKMQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPNATCGAGTFMASHFDRHYCGKCGLTY

SEQ ID NO: 6288 - protein, 169 aa, Zea mays
  misc_feature (1)..(169): useful for making plants with modified plant phenotypes as described in USSN 12/139,269
  misc_feature (1)..(169): Ceres CLONE ID no. 1449840
  misc_feature (1)..(169): Utility: Useful for increasing chlorophyll and photosynthetic capacity
  misc_feature (1)..(169): Utility: Useful for making ornamental plants with modified leaves
  misc_feature (1)..(169): Utility: Useful for making plants sterile and for genetic confinement
  misc_feature (1)..(169): Utility: Useful for making plants with increased biomass
  misc_feature (1)..(169): Utility: Useful for making plants with increased biomass and foliage
  misc_feature (1)..(169): Utility: Useful for making smaller plants
  misc_feature (163)..(163): Xaa is any aa, unknown or other
  misc_feature (164)..(164): Xaa is any aa, unknown or other
HSAVCFVSTAAKMQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPNATCGAGTFMASHFDRHYCGKCGLTYVYXXEGAEA

SEQ ID NO: 6289 - protein, 157 aa, Arabidopsis thaliana
  misc_feature (1)..(157): useful for making plants with modified plant phenotypes as described in USSN 12/139,269
  misc_feature (1)..(157): Ceres CLONE ID no. 34004
  misc_feature (1)..(157): Utility: Useful for increasing chlorophyll and photosynthetic capacity
  misc_feature (1)..(157): Utility: Useful for making ornamental plants with modified leaves
  misc_feature (1)..(157): Utility: Useful for making plants sterile and for genetic confinement
  misc_feature (1)..(157): Utility: Useful for making plants with increased biomass
  misc_feature (1)..(157): Utility: Useful for making plants with increased biomass and foliage
  misc_feature (1)..(157): Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPNATCGAGTFMASHFDRHYCGKCGLTYVYQKEGAQE

SEQ ID NO: 6290 - protein, 157 aa, Arabidopsis thaliana; identical to SEQ ID NO: 6289
  misc_feature (1)..(157): useful for making plants with modified plant phenotypes as described in USSN 12/139,269
  misc_feature (1)..(157): Public GI no. 23505779
  misc_feature (1)..(157): Utility: Useful for increasing chlorophyll and photosynthetic capacity
  misc_feature (1)..(157): Utility: Useful for making ornamental plants with modified leaves
  misc_feature (1)..(157): Utility: Useful for making plants sterile and for genetic confinement
  misc_feature (1)..(157): Utility: Useful for making plants with increased biomass
  misc_feature (1)..(157): Utility: Useful for making plants with increased biomass and foliage
  misc_feature (1)..(157): Utility: Useful for making smaller plants

SEQ ID NO: 6291 - protein, 161 aa, Glycine max
  misc_feature (1)..(161): useful for making plants with modified plant phenotypes as described in USSN 12/139,269
  misc_feature (1)..(161): Ceres CLONE ID no. 1060748
  misc_feature (1)..(161): Utility: Useful for increasing chlorophyll and photosynthetic capacity
  misc_feature (1)..(161): Utility: Useful for making ornamental plants with modified leaves
  misc_feature (1)..(161): Utility: Useful for making plants sterile and for genetic confinement
  misc_feature (1)..(161): Utility: Useful for making plants with increased biomass
  misc_feature (1)..(161): Utility: Useful for making plants with increased biomass and foliage
  misc_feature (1)..(161): Utility: Useful for making smaller plants
  misc_feature (65)..(65): Xaa is any aa, unknown or other
  misc_feature (161)..(161): Xaa is any aa, unknown or other
AVCFVSTAAKMQIFVKTLTGKTITLEVESSDTIDNVKAKIQDKEGIPPDQQRLIFAGKQLEDGRXLADYNIQKESTLHLVLRLRGGAKKRKKKTYTKPKKIKHKHKKVKLAVLQFYKVDGSGKVQRLRKECPNATCGAGTFMASHFDRHYCGKCGLTYVYX

SEQ ID NO: 6292 - protein, 155 aa, Glycine max
  misc_feature (1)..(155): useful for making plants with modified plant phenotypes as described in USSN 12/139,269
  misc_feature (1)..(155): Public GI no. 438111
  misc_feature (1)..(155): Utility: Useful for increasing chlorophyll and photosynthetic capacity
  misc_feature (1)..(155): Utility: Useful for making ornamental plants with modified leaves
  misc_feature (1)..(155): Utility: Useful for making plants sterile and for genetic confinement
  misc_feature (1)..(155): Utility: Useful for making plants with increased biomass
  misc_feature (1)..(155): Utility: Useful for making plants with increased biomass and foliage
  misc_feature (1)..(155): Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGQTYVYQKADA

SEQ ID NO: 6293 - protein, 155 aa, Glycine max
  misc_feature (1)..(155): useful for making plants with modified plant phenotypes as described in USSN 12/139,269
  misc_feature (1)..(155): Public GI no. 438109
  misc_feature (1)..(155): Utility: Useful for increasing chlorophyll and photosynthetic capacity
  misc_feature (1)..(155): Utility: Useful for making ornamental plants with modified leaves
  misc_feature (1)..(155): Utility: Useful for making plants sterile and for genetic confinement
  misc_feature (1)..(155): Utility: Useful for making plants with increased biomass
  misc_feature (1)..(155): Utility: Useful for making plants with increased biomass and foliage
  misc_feature (1)..(155): Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNTECGAGTFMANHFDRHYCGKCGKTYVYQKADA

SEQ ID NO: 6294 - protein, 156 aa, Glycine max
  misc_feature (1)..(156): useful for making plants with modified plant phenotypes as described in USSN 12/139,269
  misc_feature (1)..(156): Public GI no. 34581769
  misc_feature (1)..(156): Utility: Useful for increasing chlorophyll and photosynthetic capacity
  misc_feature (1)..(156): Utility: Useful for making ornamental plants with modified leaves
  misc_feature (1)..(156): Utility: Useful for making plants sterile and for genetic confinement
  misc_feature (1)..(156): Utility: Useful for making plants with increased biomass
  misc_feature (1)..(156): Utility: Useful for making plants with increased biomass and foliage
  misc_feature (1)..(156): Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSGKVQRLRKECPNAECGAGTFMANHFDRHYCGKCGLTYVYNKAGGD

SEQ ID NO: 6295 - protein, 157 aa, Zea mays
  misc_feature (1)..(157): useful for making plants with modified plant phenotypes as described in USSN 12/139,269
  misc_feature (1)..(157): Ceres CLONE ID no. 1063698
  misc_feature (1)..(157): Utility: Useful for increasing chlorophyll and photosynthetic capacity
  misc_feature (1)..(157): Utility: Useful for making ornamental plants with modified leaves
  misc_feature (1)..(157): Utility: Useful for making plants sterile and for genetic confinement
  misc_feature (1)..(157): Utility: Useful for making plants with increased biomass
  misc_feature (1)..(157): Utility: Useful for making plants with increased biomass and foliage
  misc_feature (1)..(157): Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPNATCGAGTFMASHFDRHYCGKCGLTYVYQKEGAEA

SEQ ID NO: 6296 - protein, 179 aa, Zea mays
  misc_feature (1)..(179): useful for making plants with modified plant phenotypes as described in USSN 12/139,269
  misc_feature (1)..(179): Ceres CLONE ID no. 1486090
  misc_feature (1)..(179): Utility: Useful for increasing chlorophyll and photosynthetic capacity
  misc_feature (1)..(179): Utility: Useful for making ornamental plants with modified leaves
  misc_feature (1)..(179): Utility: Useful for making plants sterile and for genetic confinement
  misc_feature (1)..(179): Utility: Useful for making plants with increased biomass
  misc_feature (1)..(179): Utility: Useful for making plants with increased biomass and foliage
  misc_feature (1)..(179): Utility: Useful for making smaller plants
KTKPTLSLVVSSFHLFVRTAAKMQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDGSGKVQRLRKECPNATCGAGTFMASHFDRHYCGKCGLTYVYQKEGAEA

SEQ ID NO: 6297 - protein, 157 aa, Zea mays; identical to SEQ ID NO: 6295
  misc_feature (1)..(157): useful for making plants with modified plant phenotypes as described in USSN 12/139,269
  misc_feature (1)..(157): Ceres CLONE ID no. 1461422
  misc_feature (1)..(157): Utility: Useful for increasing chlorophyll and photosynthetic capacity
  misc_feature (1)..(157): Utility: Useful for making ornamental plants with modified leaves
  misc_feature (1)..(157): Utility: Useful for making plants sterile and for genetic confinement
  misc_feature (1)..(157): Utility: Useful for making plants with increased biomass
  misc_feature (1)..(157): Utility: Useful for making plants with increased biomass and foliage
  misc_feature (1)..(157): Utility: Useful for making smaller plants

SEQ ID NO: 6298 - protein, 154 aa, Zea mays
  misc_feature (1)..(154): useful for making plants with modified plant phenotypes as described in USSN 12/139,269
  misc_feature (1)..(154): Public GI no. 18252349
  misc_feature (1)..(154): Utility: Useful for increasing chlorophyll and photosynthetic capacity
  misc_feature (1)..(154): Utility: Useful for making ornamental plants with modified leaves
  misc_feature (1)..(154): Utility: Useful for making plants sterile and for genetic confinement
  misc_feature (1)..(154): Utility: Useful for making plants with increased biomass
  misc_feature (1)..(154): Utility: Useful for making plants with increased biomass and foliage
  misc_feature (1)..(154): Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDSRKVQRLRKECPNAECGAGTFMANHFDRHYCGKCGLTYVYQKAG

SEQ ID NO: 6299 - protein, 172 aa, Arabidopsis thaliana
  misc_feature (1)..(172): useful for making plants with modified plant phenotypes as described in USSN 12/139,269
  misc_feature (1)..(172): Ceres CLONE ID no. 1233
  misc_feature (1)..(172): Utility: Useful for increasing chlorophyll and photosynthetic capacity
  misc_feature (1)..(172): Utility: Useful for making ornamental plants with modified leaves
  misc_feature (1)..(172): Utility: Useful for making plants sterile and for genetic confinement
  misc_feature (1)..(172): Utility: Useful for making plants with increased biomass
  misc_feature (1)..(172): Utility: Useful for making plants with increased biomass and foliage
  misc_feature (1)..(172): Utility: Useful for making smaller plants
KNPHFDNLQQPLPQKMQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKIDGSGKVQRLRKECPNATCGAGTFMASHFDRHYCGKCGLTYVYQKEGVEA

SEQ ID NO: 6300 - protein, 157 aa, Arabidopsis thaliana
  misc_feature (1)..(157): useful for making plants with modified plant phenotypes as described in USSN 12/139,269
  misc_feature (1)..(157): Public GI no. 21537196
  misc_feature (1)..(157): Utility: Useful for increasing chlorophyll and photosynthetic capacity
  misc_feature (1)..(157): Utility: Useful for making ornamental plants with modified leaves
  misc_feature (1)..(157): Utility: Useful for making plants sterile and for genetic confinement
  misc_feature (1)..(157): Utility: Useful for making plants with increased biomass
  misc_feature (1)..(157): Utility: Useful for making plants with increased biomass and foliage
  misc_feature (1)..(157): Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKIDGSGKVQRLRKECPNATCGAGTFMASHFDRHYCGKCGLTYVYQKEGVEA

SEQ ID NO: 6301 - protein, 155 aa, Glycine max
  misc_feature (1)..(155): useful for making plants with modified plant phenotypes as described in USSN 12/139,269
  misc_feature (1)..(155): Ceres CLONE ID no. 544375
  misc_feature (1)..(155): Utility: Useful for increasing chlorophyll and photosynthetic capacity
  misc_feature (1)..(155): Utility: Useful for making ornamental plants with modified leaves
  misc_feature (1)..(155): Utility: Useful for making plants sterile and for genetic confinement
  misc_feature (1)..(155): Utility: Useful for making plants with increased biomass
  misc_feature (1)..(155): Utility: Useful for making plants with increased biomass and foliage
  misc_feature (1)..(155): Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLGILQFYKVDDSGKVQRLRKECPNAECGAGTFMANHFDRHYCGKCGLTYVYQKADA

SEQ ID NO: 6302 - protein, 155 aa, Glycine max; identical to SEQ ID NO: 6301
  misc_feature (1)..(155): useful for making plants with modified plant phenotypes as described in USSN 12/139,269
  misc_feature (1)..(155): Ceres CLONE ID no. 545629
  misc_feature (1)..(155): Utility: Useful for increasing chlorophyll and photosynthetic capacity
  misc_feature (1)..(155): Utility: Useful for making ornamental plants with modified leaves
  misc_feature (1)..(155): Utility: Useful for making plants sterile and for genetic confinement
  misc_feature (1)..(155): Utility: Useful for making plants with increased biomass
  misc_feature (1)..(155): Utility: Useful for making plants with increased biomass and foliage
  misc_feature (1)..(155): Utility: Useful for making smaller plants

SEQ ID NO: 6303 - protein, 155 aa, Glycine max
  misc_feature (1)..(155): useful for making plants with modified plant phenotypes as described in USSN 12/139,269
  misc_feature (1)..(155): Ceres CLONE ID no. 850326
  misc_feature (1)..(155): Utility: Useful for increasing chlorophyll and photosynthetic capacity
  misc_feature (1)..(155): Utility: Useful for making ornamental plants with modified leaves
  misc_feature (1)..(155): Utility: Useful for making plants sterile and for genetic confinement
  misc_feature (1)..(155): Utility: Useful for making plants with increased biomass
  misc_feature (1)..(155): Utility: Useful for making plants with increased biomass and foliage
  misc_feature (1)..(155): Utility: Useful for making smaller plants
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLALLQFYKVDDSGKVQRLRKECPNAECGAGTFMANHFDRHYCGKCGLTYVYQKAEA

SEQ ID NO: 6304 - DNA, 639 bp, Arabidopsis thaliana
  misc_feature (1)..(639): useful for making plants with modified plant phenotypes as described in USSN 12/139,269
  misc_feature (1)..(639): Ceres CLONE ID no. 2561
  misc_feature (1)..(639): Also known as  Ceres CDNA ID no. 23384666
cagcaaaaaaaaaccctaatttcttcacaaattcagcggcgatgaagttcaatccgcgtgtgagctcttctcgccggaagaacaggaaggctcacttcacagctccttcaagcgtgaggcgcgttctcatgagctcgccgttatccaaggatctccgtaacaaacacaacgtcagatccatgccgattcgtaaagacgacgaagtgcaagttgttcgtgggacgttcaagggaagagaagggaaggtgatgcaggtgtatcgccgcaagtgggtgattcacatcgagagaatcacaagggagaaagtcaacggatccacggtcaacgtcggagtcaatgcttcgaatgtgatgatcactaagctccgtctcgataaggataggaagtcgcttttggagcgtaaggctaatggacgcgccgccgccgataaggagaagggaaccaagttttcagccgaagatgtcatggagaacgtagattgatcttaacgtatggttttttcttcttcttttctagttttctattttgatttcattgatgatgatatgattcagaattcgaagttgaattttgtggttttcttatcaatgtacctcatttatgcttatatttctagctattgaaattggattgagattt

SEQ ID NO: 6305 - protein, 92 aa, Arabidopsis thaliana
  misc_feature (1)..(92): useful for making plants with modified plant phenotypes as described in USSN 12/139,269
  misc_feature (2)..(28): Pfam Name: KOW; Pfam Description: KOW motif
  misc_feature (1)..(92): Utility: Useful for increasing chlorophyll and photosynthetic capacity
  misc_feature (1)..(92): Utility: Useful for making ornamental plants with modified leaves
  misc_feature (1)..(92): Utility: Useful for making plants sterile and for genetic confinement
  misc_feature (1)..(92): Utility: Useful for making smaller plants
MQVVRGTFKGREGKVMQVYRRKWVIHIERITREKVNGSTVNVGVNASNVMITKLRLDKDRKSLLERKANGRAAADKEKGTKFSAEDVMENVD

SEQ ID NO: 6306 - protein, 146 aa, Glycine max
  misc_feature (1)..(146): useful for making plants with modified plant phenotypes as described in USSN 12/139,269
  misc_feature (1)..(146): Ceres CLONE ID no. 1248535
  misc_feature (1)..(146): Utility: Useful for increasing chlorophyll and photosynthetic capacity
  misc_feature (1)..(146): Utility: Useful for making ornamental plants with modified leaves
  misc_feature (1)..(146): Utility: Useful for making plants sterile and for genetic confinement
  misc_feature (1)..(146): Utility: Useful for making smaller plants
MKYNPRVTSSRRKNRKAHFTASSSERRVIMSSPLSTDLRAKYNVRSMPIRKDDEVQIVRGTYKGREGKVVQVYRRKWVIHIERITREKVNGTTVNVGVQPSKVVITKLRLDKDRKSLLERKAKGRAAADKDKGTKFTAEDVMQNVD

SEQ ID NO: 6307 - protein, 146 aa, Arabidopsis thaliana
  misc_feature (1)..(146): useful for making plants with modified plant phenotypes as described in USSN 12/139,269
  misc_feature (1)..(146): Ceres CLONE ID no. 22819
  misc_feature (1)..(146): Utility: Useful for increasing chlorophyll and photosynthetic capacity
  misc_feature (1)..(146): Utility: Useful for making ornamental plants with modified leaves
  misc_feature (1)..(146): Utility: Useful for making plants sterile and for genetic confinement
  misc_feature (1)..(146): Utility: Useful for making smaller plants
MKYNPRVTSSRRKNRKAHFTASSSERRVIMSSPLSTDLRQKYNVRSMPIRKDDEVQIVRGTYKGREGKVVQVYRRKWVIHIERITREKVNGTTVNVGIQPSKVVITKLRLDKDRKSLLERKAKGRAAADKEKGTKFTSEDVMQNVD

SEQ ID NO: 6308 - protein, 146 aa, Glycine max
  misc_feature (1)..(146): useful for making plants with modified plant phenotypes as described in USSN 12/139,269
  misc_feature (1)..(146): Ceres CLONE ID no. 463579
  misc_feature (1)..(146): Utility: Useful for increasing chlorophyll and photosynthetic capacity
  misc_feature (1)..(146): Utility: Useful for making ornamental plants with modified leaves
  misc_feature (1)..(146): Utility: Useful for making plants sterile and for genetic confinement
  misc_feature (1)..(146): Utility: Useful for making smaller plants
MKFNPRVSSSRRKSRKAHFTAPSSVRRVLMSAPLSTDLRSKYNVRSIPVRKDDEVQVVRGTYKGREGKVVQVYRRKWVIHIERITREKVNGSTVNVGIHPSKVVVTKLRMDKDRKSLLDRKAKGRAAADKEKGTKFAPEDVMQTVD

SEQ ID NO: 6309 - protein, 146 aa, Glycine max
  misc_feature (1)..(146): useful for making plants with modified plant phenotypes as described in USSN 12/139,269
  misc_feature (1)..(146): Ceres CLONE ID no. 1608715
  misc_feature (1)..(146): Utility: Useful for increasing chlorophyll and photosynthetic capacity
  misc_feature (1)..(146): Utility: Useful for making ornamental plants with modified leaves
  misc_feature (1)..(146): Utility: Useful for making plants sterile and for genetic confinement
  misc_feature (1)..(146): Utility: Useful for making smaller plants
MKFNPRVSSSRRKSRKAHFTAPSSVRRVLMSAPLSTDLRSKYNVRSIPVRKDDEVQVVRGTYKGREGKVVQVYRRKWVIHIERITREKVNGSTVNVGIHPSKVVVTKLRMDKDRKSLLDRKAKGRAAADKEKGTKFAPEDIMQTVD

SEQ ID NO: 6310 - protein, 157 aa, Zea mays
  misc_feature (1)..(157): useful for making plants with modified plant phenotypes as described in USSN 12/139,269
  misc_feature (1)..(157): Ceres CLONE ID no. 1440308
  misc_feature (1)..(157): Utility: Useful for increasing chlorophyll and photosynthetic capacity
  misc_feature (1)..(157): Utility: Useful for making ornamental plants with modified leaves
  misc_feature (1)..(157): Utility: Useful for making plants sterile and for genetic confinement
  misc_feature (1)..(157): Utility: Useful for making smaller plants
MKRNPRVTSSRRKCRKAHFTAPSSVRRVLMSAALSSELRHKYNVRSIPIRKDDEVQVVRGTFKGREGKVVQVYRRRWVIHVERITREKVNGSTVNVGIHPSKVIVTKLKLDKDRKALLDRKARGRAADKAKGKFTAEDVAAAAGGATATGASLQEID

SEQ ID NO: 6311 - protein, 128 aa, Zea mays
  misc_feature (1)..(128): useful for making plants with modified plant phenotypes as described in USSN 12/139,269
  misc_feature (1)..(128): Ceres CLONE ID no. 297892
  misc_feature (1)..(128): Utility: Useful for increasing chlorophyll and photosynthetic capacity
  misc_feature (1)..(128): Utility: Useful for making ornamental plants with modified leaves
  misc_feature (1)..(128): Utility: Useful for making plants sterile and for genetic confinement
  misc_feature (1)..(128): Utility: Useful for making smaller plants
MSAALSTELRHKYNVRSIPIRKDDEVQVVRGTYKGREGKVVQVYRRRWVIHVERITREKVNGSTVNVGIHPSKVMVTKLKLDKDRKALLDRKARGRAADKAKGKFTADDVAAAAGGAAATGASLQEID

SEQ ID NO: 6312 - protein, 135 aa, Glycine max
  misc_feature (1)..(135): useful for making plants with modified plant phenotypes as described in USSN 12/139,269
  misc_feature (1)..(135): Ceres CLONE ID no. 479756
  misc_feature (1)..(135): Utility: Useful for increasing chlorophyll and photosynthetic capacity
  misc_feature (1)..(135): Utility: Useful for making ornamental plants with modified leaves
  misc_feature (1)..(135): Utility: Useful for making plants sterile and for genetic confinement
  misc_feature (1)..(135): Utility: Useful for making smaller plants
MSAPLSAELRSKYNVRSIPVRKEDEVQVMRGTYKGREGKVTQVYRRKWVIHIERITREKVNGSTVNVGIHPSKVVLTKLKLDKDRKAILDRKAKGRAAADKEKGSGLRNRSLENKALIVSGSGEECLACNCRRKG

SEQ ID NO: 6313 - protein, 146 aa, Glycine max
  misc_feature (1)..(146): useful for making plants with modified plant phenotypes as described in USSN 12/139,269
  misc_feature (1)..(146): Ceres CLONE ID no. 467309
  misc_feature (1)..(146): Utility: Useful for increasing chlorophyll and photosynthetic capacity
  misc_feature (1)..(146): Utility: Useful for making ornamental plants with modified leaves
  misc_feature (1)..(146): Utility: Useful for making plants sterile and for genetic confinement
  misc_feature (1)..(146): Utility: Useful for making smaller plants
MKFNPRVSSSRRKSRKAHFTAPSSVRRVLMSAPLSAELRSKYNVRSIPVRKEDEVQVVRGTYKGREGKVTQVYRRKWVIHIERITREKVNGSTVNVGIHPSKVVVTKLKLDKDRKAILDRKAKGRAAADKEKGTKFAPEDIMQTVD

SEQ ID NO: 6314 - protein, 106 aa, Triticum aestivum
  misc_feature (1)..(106): useful for making plants with modified plant phenotypes as described in USSN 12/139,269
  misc_feature (1)..(106): Ceres CLONE ID no. 1316364
  misc_feature (1)..(106): Utility: Useful for increasing chlorophyll and photosynthetic capacity
  misc_feature (1)..(106): Utility: Useful for making ornamental plants with modified leaves
  misc_feature (1)..(106): Utility: Useful for making plants sterile and for genetic confinement
  misc_feature (1)..(106): Utility: Useful for making smaller plants
  misc_feature (3)..(3): Xaa is any aa, unknown or other
  misc_feature (21)..(21): Xaa is any aa, unknown or other
  misc_feature (28)..(28): Xaa is any aa, unknown or other
  misc_feature (35)..(35): Xaa is any aa, unknown or other
  misc_feature (36)..(36): Xaa is any aa, unknown or other
  misc_feature (39)..(39): Xaa is any aa, unknown or other
  misc_feature (45)..(45): Xaa is any aa, unknown or other
  misc_feature (51)..(51): Xaa is any aa, unknown or other
  misc_feature (56)..(56): Xaa is any aa, unknown or other
  misc_feature (57)..(57): Xaa is any aa, unknown or other
  misc_feature (60)..(60): Xaa is any aa, unknown or other
MTXVQVVRGTFKGREGKVVQXYRRRWVXHVERITXXKVXGSTVNXGIHPSXVIVTXXKLXKDRKALLVRKARGRAADKAKGKFTAEEVAAAAGGSTATGASLQEID

SEQ ID NO: 6315 - DNA, 814 bp, Arabidopsis thaliana
  misc_feature (1)..(814): useful for making plants with modified plant phenotypes as described in USSN 12/139,269
  misc_feature (1)..(814): Ceres CLONE ID no. 3618
  misc_feature (1)..(814): Also known as  Ceres CDNA ID no. 23375900
gatacttcaaaaaacacaaaaagaaatttatatttattgatgatggaagaagagcaaagcaaatgagagacagagacacagaccctatatcagagagtaaattggtgaagtggattggatcacataagccatggagtctccgagaaaccatggaggctctgaagaggaggaatacagcagttgtgagtcagggtggactatgtacatagaagacgccttccatggaaatgaccaatcatctgttgttgtcgatgatgatgatgatgatacacaggttaaagaggctgatgatggttatgagaacaatgatggcgatactagtgatgatggtggtgatgaagagagtgatgattccatggcttctgatgcatcctcggggcctagcaatcagcttccaaagcacatcaacaaacatgcagctaggaagaatggttctaaacaagtctaccttcaaaaacgccaacacacagagaaaacaatcagcaacgaaggagaaaaatcagacctcaaagctagaacaagaacaagtgcagctagtcgtgtccagagtagagggaaggtgagcaaaaccaaataaaactcatggcgaatgagagaagaagatatgggggttcacaaagaatccaaatcctgtagtgaagagagacgtttcaggggtctcaccaatcgtgttgtttgcctttaataagccatgtgtaggtagttgcattgttttcttttgccggaatatgtttttttgtagaagctgtcccaaataagttatctgcacggttctccgttggaaccctgttatataatatgtaccttgttctcc

SEQ ID NO: 6316 - protein, 148 aa, Arabidopsis thaliana
  misc_feature (1)..(148): useful for making plants with modified plant phenotypes as described in USSN 12/139,269
  misc_feature (1)..(148): Utility: Useful for increasing chlorophyll and photosynthetic capacity
  misc_feature (1)..(148): Utility: Useful for increasing seed/fruit yield or modifying fruit content
  misc_feature (1)..(148): Utility: Useful for making larger plants
  misc_feature (1)..(148): Utility: Useful for making ornamental plants with modified flowers
  misc_feature (1)..(148): Utility: Useful for making plants sterile and for genetic confinement
  misc_feature (1)..(148): Utility: Useful for making plants with altered leaf shape eg curled leaves
  misc_feature (1)..(148): Utility: Useful for making plants with increased biomass and foliage
  misc_feature (1)..(148): Utility: Useful for making shorter plants and plants with modified flowers
  misc_feature (1)..(148): Utility: Useful for making smaller plants
  misc_feature (1)..(148): Utility: Useful for making stronger plants
  misc_feature (1)..(148): Utility: Useful for modifying fruit shape, composition and seed yield
MESPRNHGGSEEEEYSSCESGWTMYIEDAFHGNDQSSVVVDDDDDDTQVKEADDGYENNDGDTSDDGGDEESDDSMASDASSGPSNQLPKHINKHAARKNGSKQVYLQKRQHTEKTISNEGEKSDLKARTRTSAASRVQSRGKVSKTK

SEQ ID NO: 6317 - protein, 164 aa, Arabidopsis thaliana
  misc_feature (1)..(164): useful for making plants with modified plant phenotypes as described in USSN 12/139,269
  misc_feature (1)..(164): Public GI no. 50947055
  misc_feature (1)..(164): Utility: Useful for increasing chlorophyll and photosynthetic capacity
  misc_feature (1)..(164): Utility: Useful for increasing seed/fruit yield or modifying fruit content
  misc_feature (1)..(164): Utility: Useful for making larger plants
  misc_feature (1)..(164): Utility: Useful for making ornamental plants with modified flowers
  misc_feature (1)..(164): Utility: Useful for making plants sterile and for genetic confinement
  misc_feature (1)..(164): Utility: Useful for making plants with altered leaf shape eg curled leaves
  misc_feature (1)..(164): Utility: Useful for making plants with increased biomass and foliage
  misc_feature (1)..(164): Utility: Useful for making shorter plants and plants with modified flowers
  misc_feature (1)..(164): Utility: Useful for making smaller plants
  misc_feature (1)..(164): Utility: Useful for making stronger plants
  misc_feature (1)..(164): Utility: Useful for modifying fruit shape, composition and seed yield
MESSHITGDDGEGCNSSESGWTMYLASPMHGDDDGGGKRSGSEGSNVDDGYGYISGRGSRKEYEDDGDGDDDDSLASDASTGPAKVKVPSAPDGDDAGGRRKHDGDEDGGGKGEEEEEEDHGLHTKFSMSSGKKAGKTEKGGEGKSSKKGQNKRGSSSRTRFFW

SEQ ID NO: 6318 - protein, 157 aa, Glycine max
  misc_feature (1)..(157): useful for making plants with modified plant phenotypes as described in USSN 12/139,269
  misc_feature (1)..(157): Ceres CLONE ID no. 520298
  misc_feature (1)..(157): Utility: Useful for increasing chlorophyll and photosynthetic capacity
  misc_feature (1)..(157): Utility: Useful for increasing seed/fruit yield or modifying fruit content
  misc_feature (1)..(157): Utility: Useful for making larger plants
  misc_feature (1)..(157): Utility: Useful for making ornamental plants with modified flowers
  misc_feature (1)..(157): Utility: Useful for making plants sterile and for genetic confinement
  misc_feature (1)..(157): Utility: Useful for making plants with altered leaf shape eg curled leaves
  misc_feature (1)..(157): Utility: Useful for making plants with increased biomass and foliage
  misc_feature (1)..(157): Utility: Useful for making shorter plants and plants with modified flowers
  misc_feature (1)..(157): Utility: Useful for making smaller plants
  misc_feature (1)..(157): Utility: Useful for making stronger plants
  misc_feature (1)..(157): Utility: Useful for modifying fruit shape, composition and seed yield
MDPSQDLASEVEFNGTESGWTTYIGSPIYNEQSNGDDEHSVDFEDYGNNYKNSHRSIYDDDNKRENNDDFNRDTDEESDDSMASDAASGPSHLHLVRINSEGSHGGLDFTEHTENDNDKIRLTKRTTKQVRKTRYEGIVGEKEEASLLVADSAASHA

SEQ ID NO: 6319 - protein, 123 aa, Glycine max
  misc_feature (1)..(123): useful for making plants with modified plant phenotypes as described in USSN 12/139,269
  misc_feature (1)..(123): Ceres CLONE ID no. 1171157
  misc_feature (1)..(123): Utility: Useful for increasing chlorophyll and photosynthetic capacity
  misc_feature (1)..(123): Utility: Useful for increasing seed/fruit yield or modifying fruit content
  misc_feature (1)..(123): Utility: Useful for making larger plants
  misc_feature (1)..(123): Utility: Useful for making ornamental plants with modified flowers
  misc_feature (1)..(123): Utility: Useful for making plants sterile and for genetic confinement
  misc_feature (1)..(123): Utility: Useful for making plants with altered leaf shape eg curled leaves
  misc_feature (1)..(123): Utility: Useful for making plants with increased biomass and foliage
  misc_feature (1)..(123): Utility: Useful for making shorter plants and plants with modified flowers
  misc_feature (1)..(123): Utility: Useful for making smaller plants
  misc_feature (1)..(123): Utility: Useful for making stronger plants
  misc_feature (1)..(123): Utility: Useful for modifying fruit shape, composition and seed yield
MYIGSPIDDAGHSSDNDDNNKKGTQAHPQDDDDDDDESDDSMASDASSGPSHHHGFADFRRDAEEENDENKYCLEKKAGKTQHKQMEGKKVEKKGMLIVDSKDKSPVQGCGKVRKNYFVGKRK

SEQ ID NO: 6320 - protein, 182 aa, Zea mays
  misc_feature (1)..(182): useful for making plants with modified plant phenotypes as described in USSN 12/139,269
  misc_feature (1)..(182): Ceres CLONE ID no. 301153
  misc_feature (1)..(182): Utility: Useful for increasing chlorophyll and photosynthetic capacity
  misc_feature (1)..(182): Utility: Useful for increasing seed/fruit yield or modifying fruit content
  misc_feature (1)..(182): Utility: Useful for making larger plants
  misc_feature (1)..(182): Utility: Useful for making ornamental plants with modified flowers
  misc_feature (1)..(182): Utility: Useful for making plants sterile and for genetic confinement
  misc_feature (1)..(182): Utility: Useful for making plants with altered leaf shape eg curled leaves
  misc_feature (1)..(182): Utility: Useful for making plants with increased biomass and foliage
  misc_feature (1)..(182): Utility: Useful for making shorter plants and plants with modified flowers
  misc_feature (1)..(182): Utility: Useful for making smaller plants
  misc_feature (1)..(182): Utility: Useful for making stronger plants
  misc_feature (1)..(182): Utility: Useful for modifying fruit shape, composition and seed yield
MESSSHITGGDDDAGGEGCNSCESGWTMYLASPMHMHGHDDDDDAGGSANQGSSVDDGYGYMISGGGNKKQDYDDDDGDGDSLASDASTGPAKAANKSPSPPPEHKHGKEDDDRGHRGGGGGGKEETKLATSSRKKAAAAGNGKLMDKAAAAAAGGGEGNSSRRGHGKGGGGGSSRRSFFLW

SEQ ID NO: 6321 - DNA, 666 bp, Arabidopsis thaliana
  misc_feature (1)..(666): useful for making plants with modified plant phenotypes as described in USSN 12/139,269
  misc_feature (1)..(666): Ceres CLONE ID no. 7191
  misc_feature (1)..(666): Also known as  Ceres CDNA ID no. 23372297
  misc_feature (562)..(562): s is g or c
  misc_feature (563)..(563): y is t/u or c
  misc_feature (566)..(566): m is a or c
  misc_feature (567)..(567): s is g or c
  misc_feature (570)..(570): s is g or c
  misc_feature (571)..(571): s is g or c
attcattcttcatttcctctgcctctttctcagatcacaaaaccctaatttcgaatctttattcttcagaatggctttctgtaacaaactcggtggtctattgagacaaaacatttcttctaacggaaatgttccggttacgtctatgctcggatctctccggttgatgtctaccaagcttttcatcggaggtctctcatggggaaccgatgacgcatccttaagggatgcttttgctcacttcggtgacgttgttgatgctaaagttatcgttgataaagagacaggaagatcaagggggtttggatttgtcaacttcaatgatgagggcgctgcaactgctgccatatcagagatggacggaaaggaactgaatggtcgtcacatccgagtgaatcctgctaatgatagaccaagtgctccacgggcttatggaggcggtggtggatacagcggaggaggtggtggtggctatggaggaggaggtggcagctacggtggtggtgatggtggtggttactaaacagaggatgtggttgtgaagaagcagttaatggttctsyttmsttsstttcttctattgaatcttatgttagtacaaaacctgaatgggatttgctgaaaactcattactcttttttttttggttaccaatcaatttggttg

SEQ ID NO: 6322 - protein, 150 aa, Arabidopsis thaliana; identical to SEQ ID NO: 6136
  misc_feature (1)..(150): useful for making plants with modified plant phenotypes as described in USSN 12/139,269
  misc_feature (37)..(108): Pfam Name: RRM_1; Pfam Description: RNA recognition motif. (a.k.a. RRM, RBD, or RNP domain)
  misc_feature (1)..(150): Utility: Useful for increasing chlorophyll and photosynthetic capacity
  misc_feature (1)..(150): Utility: Useful for making smaller plants

SEQ ID NO: 6323 - protein, 153 aa, Zea mays
  misc_feature (1)..(153): useful for making plants with modified plant phenotypes as described in USSN 12/139,269
  misc_feature (1)..(153): Ceres CLONE ID no. 1388283
  misc_feature (1)..(153): Utility: Useful for increasing chlorophyll and photosynthetic capacity
  misc_feature (1)..(153): Utility: Useful for making smaller plants
MAFCKSLGGLLRQGVVSQTGNIPVTSVLGSLRYMSTKLFVGGLSWGTDDQSLREAFANFGEVVDAKVIVDRETGRSRGFGFVNFTDETAANTAISEMDGKDLNGRSIRVNVANERPSTPRYGGGGGYGGGGGYGGGGYGGGSYGAGGGDGGGY

SEQ ID NO: 6324 - protein, 119 aa, Zea mays
  misc_feature (1)..(119): useful for making plants with modified plant phenotypes as described in USSN 12/139,269
  misc_feature (1)..(119): Ceres CLONE ID no. 322573
  misc_feature (1)..(119): Utility: Useful for increasing chlorophyll and photosynthetic capacity
  misc_feature (1)..(119): Utility: Useful for making smaller plants
MSTKLFIGGLDWGVDDVKLREAFSSFGEVTEARVITDRETGRSRGFGFVNYSDSDAAKEAISAMDGKEIDGRQVRVNMANERPAGNRGGGGYGGGGYGGGGYGGGGGYGGGGLIYRFAL

SEQ ID NO: 6325 - protein, 122 aa, Zea mays
  misc_feature (1)..(122): useful for making plants with modified plant phenotypes as described in USSN 12/139,269
  misc_feature (1)..(122): Ceres CLONE ID no. 289956
  misc_feature (1)..(122): Utility: Useful for increasing chlorophyll and photosynthetic capacity
  misc_feature (1)..(122): Utility: Useful for making smaller plants
MSTKLFIGGLDWGVDDVKLREAFSSFGEVTEARVITDRETGRSRGFGFVNYSDSDAAKEAISAMDGKEIDGRQVRVNMANERPAGNRGGGGYGGGGYGGGGYGGGGGYGGGGYGGGSQSYDA

SEQ ID NO: 6326 - protein, 123 aa, Brassica napus; identical to SEQ ID NO: 5953
  misc_feature (1)..(123): useful for making plants with modified plant phenotypes as described in USSN 12/139,269
  misc_feature (1)..(123): Ceres CLONE ID no. 972545
  misc_feature (1)..(123): Utility: Useful for increasing chlorophyll and photosynthetic capacity
  misc_feature (1)..(123): Utility: Useful for making smaller plants
  misc_feature (11)..(11): Xaa is any aa, unknown or other
  misc_feature (27)..(27): Xaa is any aa, unknown or other
  misc_feature (78)..(78): Xaa is any aa, unknown or other
  misc_feature (80)..(80): Xaa is any aa, unknown or other
  misc_feature (108)..(108): Xaa is any aa, unknown or other
  misc_feature (120)..(120): Xaa is any aa, unknown or other

SEQ ID NO: 6327 - protein, 136 aa, Brassica napus; identical to SEQ ID NO: 5948
  misc_feature (1)..(136): useful for making plants with modified plant phenotypes as described in USSN 12/139,269
  misc_feature (1)..(136): Ceres CLONE ID no. 1091493
  misc_feature (1)..(136): Utility: Useful for increasing chlorophyll and photosynthetic capacity
  misc_feature (1)..(136): Utility: Useful for making smaller plants

SEQ ID NO: 6328 - protein, 134 aa, Brassica napus; identical to SEQ ID NO: 5947
  misc_feature (1)..(134): useful for making plants with modified plant phenotypes as described in USSN 12/139,269
  misc_feature (1)..(134): Ceres CLONE ID no. 977670
  misc_feature (1)..(134): Utility: Useful for increasing chlorophyll and photosynthetic capacity
  misc_feature (1)..(134): Utility: Useful for making smaller plants

SEQ ID NO: 6329 - protein, 133 aa, Brassica napus; identical to SEQ ID NO: 5952
  misc_feature (1)..(133): useful for making plants with modified plant phenotypes as described in USSN 12/139,269
  misc_feature (1)..(133): Ceres CLONE ID no. 963616
  misc_feature (1)..(133): Utility: Useful for increasing chlorophyll and photosynthetic capacity
  misc_feature (1)..(133): Utility: Useful for making smaller plants
  misc_feature (13)..(13): Xaa is any aa, unknown or other

SEQ ID NO: 6330 - DNA, 1706 bp, Arabidopsis thaliana
  misc_feature (1)..(1706): useful for making plants with modified plant phenotypes as described in USSN 12/139,269
  misc_feature (1)..(1706): Ceres CLONE ID no. 8254
  misc_feature (1)..(1706): Also known as  Ceres CDNA ID no. 23556816
aattaacaagttttaaactttttctccggagctctgactcttcttctctccggatccaaaaatgaatcgtctcttttctctcttctccatagctctgatcgctttcctctgcctccaccatcatgttctcgcttcttcctcttccgacttcgaaggtttcgatgctgaagacgacgatgtttcagaagattccactgagcttcaccactctctccgtcctcctcttctgactcagtctgagtcaacggttctggatctggacccatctcccgattctgattctactcctgcatctaaatctgatcctcccactcagaccgtgaagccttcgtcctccatctccttcgattactgggatgaagatgagttcgaaggattgccggaggatgagaaatctacggagtctccggttttttccgatgacgcctcctctcctgccgatccacagacgccggatcttgagtctgcttcagaaactccagatactgacattccgaagaagatgcaatcgtacactgtggagatcgtttgcgtctctatattgattggttacgctatcaattacttcactggtaaacgtgaaaatgagaacctcgctttggcttgggcttccaaatttggtcttaaagatacgatttttgagaagaacttcagtttgcttggagttggtgaaggagaagactctcctttgttgctgaaagaagcgacgaatgtgtttaagttctatgccagtgggcgtaggtattgccatgggcttttggcgactttggagcttaagagtagacacgatctgatctcaaggctattcaactctgtcgtgccttgtaaagatgagattagttttgaggtgtatatgaatgatgaagccatggatcacattgtgtttgctatggcgaggaagaaggcggctaaaacgatgcacaaggagctgggggatctgcagagatttggagggatggttcccagtcctggcgggaggaagtgggtaacggaggagttagctgtggtctctgagtctaaggaggtagctggagatatgatcaccgatgttgtacttgatcaggtttttggtgacaagtcttttgaaaagtttgggaagtatttcatctcaatgcatttctcggatcaacatcctggcaaacacaggaagatgctgcttttcaagtttgccttacctgatattaaacacatggatgatatggttcggttgatagcgctaattccgtattacattgacttaattgggcgctacaagctcagctctcaggcaaggaacaaaactgacggtgctaggcaaaaggcggctcaggaagcgtacaaggaacttgagaatgtgagacaagaggcattgcagagaaagaaagccgaaaagaagaaaatattggaggaggcacaggcaaagcttagctccgaggctctaaggaagaaagaagcaaaagaacgtgcacgccagatgaaaaagtcaatgccgaaagttaagatgagtcgtggtcactagaatcaagcataagggacacactgtcatgtcgtccattggaatagctactccctttttagtcctttcgattagatattttgaactttcatgaatctctctacttgcagttgatttttacttcattacgatttcccctatagtggcaccgaggccttacttccgataatcctccgggacctctttgaatcataagatgagttttgaagtc

SEQ ID NO: 6331 - protein, 478 aa, Arabidopsis thaliana
  misc_feature (1)..(478): useful for making plants with modified plant phenotypes as described in USSN 12/139,269
  misc_feature (144)..(472): Pfam Name: DUF1682; Pfam Description: Protein of unknown function (DUF1682)
  misc_feature (1)..(478): Utility: Useful for increasing chlorophyll and photosynthetic capacity
  misc_feature (1)..(478): Utility: Useful for making ornamental plants with modified leaves
  misc_feature (1)..(478): Utility: Useful for making plants with increased biomass and foliage
  misc_feature (1)..(478): Utility: Useful for making smaller plants
  misc_feature (1)..(478): Utility: Useful for making stronger plants
MNRLFSLFSIALIAFLCLHHHVLASSSSDFEGFDAEDDDVSEDSTELHHSLRPPLLTQSESTVLDLDPSPDSDSTPASKSDPPTQTVKPSSSISFDYWDEDEFEGLPEDEKSTESPVFSDDASSPADPQTPDLESASETPDTDIPKKMQSYTVEIVCVSILIGYAINYFTGKRENENLALAWASKFGLKDTIFEKNFSLLGVGEGEDSPLLLKEATNVFKFYASGRRYCHGLLATLELKSRHDLISRLFNSVVPCKDEISFEVYMNDEAMDHIVFAMARKKAAKTMHKELGDLQRFGGMVPSPGGRKWVTEELAVVSESKEVAGDMITDVVLDQVFGDKSFEKFGKYFISMHFSDQHPGKHRKMLLFKFALPDIKHMDDMVRLIALIPYYIDLIGRYKLSSQARNKTDGARQKAAQEAYKELENVRQEALQRKKAEKKKILEEAQAKLSSEALRKKEAKERARQMKKSMPKVKMSRGH

SEQ ID NO: 6332 - protein, 460 aa, Glycine max
  misc_feature (1)..(460): useful for making plants with modified plant phenotypes as described in USSN 12/139,269
  misc_feature (1)..(460): Ceres CLONE ID no. 635423
  misc_feature (1)..(460): Utility: Useful for increasing chlorophyll and photosynthetic capacity
  misc_feature (1)..(460): Utility: Useful for making ornamental plants with modified leaves
  misc_feature (1)..(460): Utility: Useful for making plants with increased biomass and foliage
  misc_feature (1)..(460): Utility: Useful for making smaller plants
  misc_feature (1)..(460): Utility: Useful for making stronger plants
MGNPSLSSLLLVLLCIISLILALAQADSDSHFEGFEAEDDDDDLEDSSIHPASLRSPPLSDPTPTPQPPPSDLPKFPPFDFWDDDEFEGVPVEHSSPEPPSDPKSPENATTTQTPPTPNPPRSFSVEIICGSFLIMFAINYFSGKRENENIALSWAAQFAAKDSIFEKNFSLLGIGDGVDEEEAPLLLKEGQTTFKFYASGRRYCQGLLATLELKSRHDLIARIYNMIVPCRDEIAFEVYMNDDAMDHVVFAMAKKKVAKAMHKDVTDLQRFGTLLSAPSATATATARKWVADDLAVISESKEVANDLITDAVIDQVFGEKAFEKFGKGLISLHFSDQHPGIHKKILLFKFVLPAAKDMADMTRLVALVPYYIDLIGRYKLSSQARSKTEAARQKAALEAQKELRNAQQEAMQRRKAERKKMVEEAEAKLSAESVRKKEAKERARQMKKAMPRMKMSRGA

SEQ ID NO: 6333 - protein, 515 aa, Zea mays
  misc_feature (1)..(515): useful for making plants with modified plant phenotypes as described in USSN 12/139,269
  misc_feature (1)..(515): Ceres CLONE ID no. 219727
  misc_feature (1)..(515): Utility: Useful for increasing chlorophyll and photosynthetic capacity
  misc_feature (1)..(515): Utility: Useful for making ornamental plants with modified leaves
  misc_feature (1)..(515): Utility: Useful for making plants with increased biomass and foliage
  misc_feature (1)..(515): Utility: Useful for making smaller plants
  misc_feature (1)..(515): Utility: Useful for making stronger plants
TSAVVASFPAPPRTIIPFVFPSTPSLPHPKAMAALSWIRLRPPRAAILILLLLALHISPSFAANFEGFDSDDLPVAAGGLDADDDEGLDGVYLPPPPPISLSTSAPSPPVTTTPAPNPNPATPTPRDPTPALDLWDEDEFEGIPVPEAIPSDDSAAPAEVDPSDPSTEAPVEVAPAAKRSPAELLRAFSFEIACASFLVCYVLNYFTGKRQNENIALAWATKFATRDSIFDKNFSLLGTGDGKDTPLLLKEGQDVFKFYASGRRFCQGLLATMEMRARYDLLSKFVELVFPRKDTITFEVVMNEEAMDHVVLAVARKKAAKTMHKEERDLQRFASVLTSAPAGRKWVSDELAVVAESKEVAGDMITEAVLDQVLGEKACEKFGKWFISLHFSDQLAGSYKKVLTFKFVLPDASNMSEMTRLVSLVPYYIDLVGRYKLSSHARSKTDGARTKAAQEAFRELQSARQEALQRKKAEKKKLMEETDAKLSAEALRRKDEKERARQMKKSGPKVKMLRS

SEQ ID NO: 6334 - protein, 490 aa, Zea mays
  misc_feature (1)..(490): useful for making plants with modified plant phenotypes as described in USSN 12/139,269
  misc_feature (1)..(490): Public GI no. 50931507
  misc_feature (1)..(490): Utility: Useful for increasing chlorophyll and photosynthetic capacity
  misc_feature (1)..(490): Utility: Useful for making ornamental plants with modified leaves
  misc_feature (1)..(490): Utility: Useful for making plants with increased biomass and foliage
  misc_feature (1)..(490): Utility: Useful for making smaller plants
  misc_feature (1)..(490): Utility: Useful for making stronger plants
MATASSIRPPRAALVLLLLALSFSLTLAAHFEGFGSDDLHSAHADAASADDEDDEGLDVELPPPPRISLSTSTPSPPVTTTTTTTSAPNPNPDPNPTLTPPNPTPTLDLWDEDEFEGIPVPEAASSDESSTPAEAAPSDPAADAAAEAAPAPPRRPAELLRAYTVEIACVSFLICFLLNYFTGKRQNEAIALAWATRFATRDSIFDKNFSLLGTGDGKDTPLLMKEGQDVFKFYASGRRYCQGMLATMEMRARHDLLSKLVELVFPRKDTITFEVVMNEEAMDHVMLAVARKKAAKTMQKEERDLQKFAGVLTSAPAGRRWVADELAVVAESKEVAGDMITEAVLDQVLGDKAFEKFGKWFISLHFSDQLAGSYKKVLSFKFVLPDASNMAEMTRLVALVPYYIDLVGRYKLSNHARSKTEAARTKASQEAFREQQGLRQEALQRKKAEKKKLMEEAEAKLSAEALRKKEEKERARQMKKSMPKVKMLRS

SEQ ID NO: 6335 - DNA, 1298 bp, Arabidopsis thaliana
  misc_feature (1)..(1298): useful for making plants with modified plant phenotypes as described in USSN 12/139,269
  misc_feature (1)..(1298): Ceres CLONE ID no. 8877
  misc_feature (1)..(1298): Also known as  Ceres CDNA ID no. 23389932
tcactataaagccgatccatagataaacgaggaccggccagaaatcgcttcaccattcccaaatctctcttccattttctccacacaaatttctcttcaatctccgataatggaaggaaccggcgttgtggcggtgtacggtaacggtgcgataacggaggcgaagaaatctcccttctccgtgaaggtcggtttggctcagatgctccgtggtggtgttatcatggatgtcgtcaacgccgagcaagctcgtatcgccgaggaggctggtgcttgcgccgtcatggctttggagcgtgttcctgctgatatccgcgctcaaggaggcgtcgctcgtatgagcgatccacaaatgattaaagaaatcaaacaagccgttacgattccggtgatggctaaggctaggattggtcatttcgttgaagctcagatccttgaagcaattggaatcgattacatcgatgagagcgaggttttgactcttgctgatgaagatcatcacatcaacaagcataatttccggatcccgttcgtttgcggttgccggaatctcggcgaggctctgaggaggatccgtgaaggtgcggcgatgattaggaccaaaggtgaagctggaaccggtaacattattgaagctgtgaggcatgtgaggtctgttaatggtgacattagggttttgcgaaacatggatgatgatgaggttttcactttcgctaagaaattagccgctccgtacgatctcgtgatgcagactaagcagcttggtcgtcttcctgtagtccaatccgccgccggtggagtggctactccggctgatgcagctctcatgatgcagcttggatgtgatggtgtctttgttggttctggtatcttcaagagcggtgacccagctcgtcgtgcacgtgccattgttcaggctgtgactcattacagtgaccctgagatgcttgtggaggtgagctgtgggcttggagaagccatggttgggatcaatctcaacgatgagaaggttgagaggttcgctaatcgctccgagtgatcaaagaaataaaaggtaaaatttctcagacgaaatggtttcagaattttctcagaccattttgcagtaatctctttgaaaagaagaagatgatgatattgttggtagtttgtatcctttgtgttttccttataatctttgatagtcttttgttattgtaatctcgtaatccctttgcaagaacaagtttgtcagttataataatgtactactctcttgatcgatcagttggttttgaatctgatatattcttcgattc

SEQ ID NO: 6336 - protein, 309 aa, Arabidopsis thaliana
  misc_feature (1)..(309): useful for making plants with modified plant phenotypes as described in USSN 12/139,269
  misc_feature (23)..(228): Pfam Name: SOR_SNZ; Pfam Description: SOR/SNZ family
  misc_feature (1)..(309): Utility: Useful for increasing chlorophyll and photosynthetic capacity
  misc_feature (1)..(309): Utility: Useful for making ornamental plants with modified leaves
  misc_feature (1)..(309): Utility: Useful for making plants with altered leaf shape eg curled leaves
  misc_feature (1)..(309): Utility: Useful for making plants with enhanced tolerance to drought
  misc_feature (1)..(309): Utility: Useful for making plants with increased biomass and foliage
  misc_feature (1)..(309): Utility: Useful for making smaller plants
MEGTGVVAVYGNGAITEAKKSPFSVKVGLAQMLRGGVIMDVVNAEQARIAEEAGACAVMALERVPADIRAQGGVARMSDPQMIKEIKQAVTIPVMAKARIGHFVEAQILEAIGIDYIDESEVLTLADEDHHINKHNFRIPFVCGCRNLGEALRRIREGAAMIRTKGEAGTGNIIEAVRHVRSVNGDIRVLRNMDDDEVFTFAKKLAAPYDLVMQTKQLGRLPVVQSAAGGVATPADAALMMQLGCDGVFVGSGIFKSGDPARRARAIVQAVTHYSDPEMLVEVSCGLGEAMVGINLNDEKVERFANRSE

SEQ ID NO: 6337 - protein, 309 aa, Arabidopsis thaliana
  misc_feature (1)..(309): useful for making plants with modified plant phenotypes as described in USSN 12/139,269
  misc_feature (1)..(309): Public GI no. 2501578
  misc_feature (1)..(309): Utility: Useful for increasing chlorophyll and photosynthetic capacity
  misc_feature (1)..(309): Utility: Useful for making ornamental plants with modified leaves
  misc_feature (1)..(309): Utility: Useful for making plants with altered leaf shape eg curled leaves
  misc_feature (1)..(309): Utility: Useful for making plants with enhanced tolerance to drought
  misc_feature (1)..(309): Utility: Useful for making plants with increased biomass and foliage
  misc_feature (1)..(309): Utility: Useful for making smaller plants
MAGTGVVAVYGNGAITETKKSPFSVKVGLAQMLRGGVIMDVVNPEQARIAEEAGACAVMALERVPADIRAQGGVARMSDPQLIKEIKQSVTIPVMAKARIGHFVEAQILEAIGIDYVDESEVLTPADEENHINKHNFRIPFVCGCRNLGEALRRIREGAAMIRTKGEAGTGNVIEAVRHVRSVMGDIRLLRNMDDDEVFTFAKKIAAPYDLVMQTKQLGRLPVVQFAAGGVATPADAALMMQLGCDGVFVGSGVFKSGDPARRARAIVQAVTHYSDPDMLAEVSCGLGEAMVGINLNDKKVERFANRSE

SEQ ID NO: 6338 - protein, 311 aa, Glycine max
  misc_feature (1)..(311): useful for making plants with modified plant phenotypes as described in USSN 12/139,269
  misc_feature (1)..(311): Ceres CLONE ID no. 707209
  misc_feature (1)..(311): Utility: Useful for increasing chlorophyll and photosynthetic capacity
  misc_feature (1)..(311): Utility: Useful for making ornamental plants with modified leaves
  misc_feature (1)..(311): Utility: Useful for making plants with altered leaf shape eg curled leaves
  misc_feature (1)..(311): Utility: Useful for making plants with enhanced tolerance to drought
  misc_feature (1)..(311): Utility: Useful for making plants with increased biomass and foliage
  misc_feature (1)..(311): Utility: Useful for making smaller plants
MEGSGSGVVTVYGNGAITETKKSPFSVKVGLAQMLRGGVIMDVVNAEQTRIAEEAGACAVMALERVPADIRAQGGVARMSDPQLIKDIKRAVTIPVMAKARIGHFVEAQILEAIGIDYVDESEVLTLADDANHINKHNFRIPFVCGCRNLGEALRRIREGAAMIRTKGEAGTGNIIEAVRHVRSVMSDIRVLRNMDDDEVFTFAKSIAAPYDLVMQTKQLGRLPVVHFAAGGVATPADAALMMQLGCDGVFVGSGVFKSGDPAKRARAIVQAVTHYSDPEVLAEVSCGLGEAMVGINLTDDKVERFANRSE

SEQ ID NO: 6339 - protein, 309 aa, Glycine max
  misc_feature (1)..(309): useful for making plants with modified plant phenotypes as described in USSN 12/139,269
  misc_feature (1)..(309): Public GI no. 46399271
  misc_feature (1)..(309): Utility: Useful for increasing chlorophyll and photosynthetic capacity
  misc_feature (1)..(309): Utility: Useful for making ornamental plants with modified leaves
  misc_feature (1)..(309): Utility: Useful for making plants with altered leaf shape eg curled leaves
  misc_feature (1)..(309): Utility: Useful for making plants with enhanced tolerance to drought
  misc_feature (1)..(309): Utility: Useful for making plants with increased biomass and foliage
  misc_feature (1)..(309): Utility: Useful for making smaller plants
MAGSGVVTLYGNGALTETTKQSPFSVKVGLAQMLRGGVIMDVVNAEQARIAEEAGACAVMALERVPADIRAQGGVARMSDPQLIKEIKQAVTIPVMAKARIGHFVEAQILEAIGIDYVDESEVLTLADDENHINKHNFRIPFVCGCRNLGEALRRIREGAAMIRTKGEAGTGNIIEAVRHVRSVMGDIRVLRNMDDDEVFTFAKKLQAPYDLVMQTKQLGRLPVVHFAAGGVATPADAALMMQLGCDGVFVGSGIFKSGDPAKRGRAIVQAVTHYSDPGLLAEISCGLGEAMVGINLDDKVERYANRSE

SEQ ID NO: 6340 - protein, 312 aa, Glycine max
  misc_feature (1)..(312): useful for making plants with modified plant phenotypes as described in USSN 12/139,269
  misc_feature (1)..(312): Public GI no. 45477167
  misc_feature (1)..(312): Utility: Useful for increasing chlorophyll and photosynthetic capacity
  misc_feature (1)..(312): Utility: Useful for making ornamental plants with modified leaves
  misc_feature (1)..(312): Utility: Useful for making plants with altered leaf shape eg curled leaves
  misc_feature (1)..(312): Utility: Useful for making plants with enhanced tolerance to drought
  misc_feature (1)..(312): Utility: Useful for making plants with increased biomass and foliage
  misc_feature (1)..(312): Utility: Useful for making smaller plants
MEGEGSRVVALYDGNGAITETKKSPFSVKVGLAQMLRGGVIMDVVNADQARIAEEAGACAVMALERVPADIRAQGGVARMSDPQLIKEIKRAVTIPVMAKARIGHFVEAQILEAIGIDYVDESEVLTLADDANHINKHNFRIPFVCGCRNLGEALRRIREGAAMIRTKGEAGTGNIIEAVRHVRSVMSDIRVLRNMDDDEVFTFAKSIAAPYDLVMQTKQLGRLPVVHFAAGGVATPADAALMMQLGCDGVFVGSGVFKSGDPAKRARAIVQAVTHYSDPEILAEVSCGLGEAMVGINLSDTNVERFANRSE

SEQ ID NO: 6341 - protein, 309 aa, Glycine max
  misc_feature (1)..(309): useful for making plants with modified plant phenotypes as described in USSN 12/139,269
  misc_feature (1)..(309): Public GI no. 17104657
  misc_feature (1)..(309): Utility: Useful for increasing chlorophyll and photosynthetic capacity
  misc_feature (1)..(309): Utility: Useful for making ornamental plants with modified leaves
  misc_feature (1)..(309): Utility: Useful for making plants with altered leaf shape eg curled leaves
  misc_feature (1)..(309): Utility: Useful for making plants with enhanced tolerance to drought
  misc_feature (1)..(309): Utility: Useful for making plants with increased biomass and foliage
  misc_feature (1)..(309): Utility: Useful for making smaller plants
MAGTGVVAVYGEGAMTETKQKSPFSVKVGLAQMLRGGVIMDVVNAEQARIAEEAGACAVMALERVPADIRAQGGVARMSDPEMIKEIKNAVTIPVMAKARIGHFVEAQILEAIGVDYVDESEVLTLADEDNHINKHNFKIPFVCGCRNLGEALRRIREGAAMIRTKGEAGTGNVVEAVRHVRSVNGAIRLLRSMDDDEVFTYAKKIAAPYDLVVQTKELGRLPVVQFAAGGVATPADAALMMQLGCDGVFVGSGVFKSGDPVKRAKAIVQAVTNYRDAAVLAEVSCGLGEAMVGLNLDDKVERFASRSE

SEQ ID NO: 6342 - protein, 340 aa, Triticum aestivum
  misc_feature (1)..(340): useful for making plants with modified plant phenotypes as described in USSN 12/139,269
  misc_feature (1)..(340): Ceres CLONE ID no. 575584
  misc_feature (1)..(340): Utility: Useful for increasing chlorophyll and photosynthetic capacity
  misc_feature (1)..(340): Utility: Useful for making ornamental plants with modified leaves
  misc_feature (1)..(340): Utility: Useful for making plants with altered leaf shape eg curled leaves
  misc_feature (1)..(340): Utility: Useful for making plants with enhanced tolerance to drought
  misc_feature (1)..(340): Utility: Useful for making plants with increased biomass and foliage
  misc_feature (1)..(340): Utility: Useful for making smaller plants
  misc_feature (157)..(157): Xaa is any aa, unknown or other
  misc_feature (167)..(167): Xaa is any aa, unknown or other
IPHAPPLFRRLPSLFSSLPLAAEKMASDGSGVVTVYGSGNNGAGTQLEPKSSPFSVKVGLAQMLRGGVIMDVVNAEQARIAEEAGACAVMALERVPADIRAQGGVARMSDPGLIREIKRAVTIPVMAKARIGHFVEAQILESIGVDYVDESEVLTLXDDAHHINKHXFRVPFVCGCRNLGEALRRIREGAAMIRTKGEAGTGNVIEAVRHVRSVMGDVRALRSMDDDEVFTYAKSIAAPYDLVMQTKQLGRLPVVQFAAGGVATPADAALMMQLGCDGVFVGSGVFKSGDPARRARAIVQAVTHYSDPNVLAEVSCDLGEAMVGINLSDPKVERFAARSE

SEQ ID NO: 6343 - protein, 318 aa, Triticum aestivum
  misc_feature (1)..(318): useful for making plants with modified plant phenotypes as described in USSN 12/139,269
  misc_feature (1)..(318): Public GI no. 50933621
  misc_feature (1)..(318): Utility: Useful for increasing chlorophyll and photosynthetic capacity
  misc_feature (1)..(318): Utility: Useful for making ornamental plants with modified leaves
  misc_feature (1)..(318): Utility: Useful for making plants with altered leaf shape eg curled leaves
  misc_feature (1)..(318): Utility: Useful for making plants with enhanced tolerance to drought
  misc_feature (1)..(318): Utility: Useful for making plants with increased biomass and foliage
  misc_feature (1)..(318): Utility: Useful for making smaller plants
MATDGTGVVTVYGSGTNGAALLEPSNHKSATFSVKVGLAQMLRGGVIMDVVTPEQARIAEEAGACAVMALERVPADIRAQGGVARMSDPGLIRDIKRAVTIPVMAKARIGHFVEAQILEAIGVDYVDESEVLTLADDAHHINKHNFRVPFVCGCRDLGEALRRIREGAAMIRTKGEAGTGNVVEAVRHVRSVMGDIRALRNMDDDEVFSYAKRIAAPYDLVMQTKQLGRLPVVQFAAGGVATPADAALMMQLGCDGVFVGSGIFKSGDPARRARAIVQAVTHYSDPKILAEVSSGLGEAMVGINLSDPKVERFAARSE

SEQ ID NO: 6344 - protein, 309 aa, Triticum aestivum
  misc_feature (1)..(309): useful for making plants with modified plant phenotypes as described in USSN 12/139,269
  misc_feature (1)..(309): Public GI no. 45477162
  misc_feature (1)..(309): Utility: Useful for increasing chlorophyll and photosynthetic capacity
  misc_feature (1)..(309): Utility: Useful for making ornamental plants with modified leaves
  misc_feature (1)..(309): Utility: Useful for making plants with altered leaf shape eg curled leaves
  misc_feature (1)..(309): Utility: Useful for making plants with enhanced tolerance to drought
  misc_feature (1)..(309): Utility: Useful for making plants with increased biomass and foliage
  misc_feature (1)..(309): Utility: Useful for making smaller plants
  misc_feature (129)..(129): Xaa is any aa, unknown or other
MASDGVVTVYGDGAITDTKVSSYAVKVGLAQMLRGGVIMDVVNAEQARIAEEAGATAVMALERVPADIRAQGGVARMSDPGLIKEIKSAVTIPVMAKARIGHFVEAQILEAIGIDYIDESEVLTPADDXHHINKHNFRIPFVCGCRNLGEALRRIAEGAAMIRTKGEAGTGNVIEAVRHVRSVLGDIRKLQSLDDDEVFAFAKQIAAPYELVRQTKQLGRLPVVNFAAGGVATPADAALMMQLGCDGVFVGSGVFKSGDPARRARAIVQAVTHYNDPHILAEVSCSLGEAMVGINLKDEKVERYAERSE

SEQ ID NO: 6345 - protein, 317 aa, Zea mays
  misc_feature (1)..(317): useful for making plants with modified plant phenotypes as described in USSN 12/139,269
  misc_feature (1)..(317): Ceres CLONE ID no. 1278155
  misc_feature (1)..(317): Utility: Useful for increasing chlorophyll and photosynthetic capacity
  misc_feature (1)..(317): Utility: Useful for making ornamental plants with modified leaves
  misc_feature (1)..(317): Utility: Useful for making plants with altered leaf shape eg curled leaves
  misc_feature (1)..(317): Utility: Useful for making plants with enhanced tolerance to drought
  misc_feature (1)..(317): Utility: Useful for making plants with increased biomass and foliage
  misc_feature (1)..(317): Utility: Useful for making smaller plants
MASDGSGVVTVYGSNGAELLEPSKQPKSATFSVKVGLAQMLRGGVIMDVVTPEQARLAEEAGACAVMALERVPADIRAQGGVARMSDPGLIRDIKRAVTIPVMAKARIGHFVEAQILEAVGVDYVDESEVLTPADDAHHINKHNFRVPFVCGCRDLGEALRRVREGAAMIRTKGEAGTGNVVEAVRHVRSVMGDVRALRSMDDDEVFAYAKRIAAPYDLVMQTKQLGRLPVVQFAAGGVATPADAALMMQLGCDGVFVGSGIFKSGDPARRARAIVQAVTHYSDPTILADVSTGLGEAMVGINLNDPKVERYAARSE

SEQ ID NO: 6346 - protein, 317 aa, Zea mays
  misc_feature (1)..(317): useful for making plants with modified plant phenotypes as described in USSN 12/139,269
  misc_feature (1)..(317): Ceres CLONE ID no. 1371669
  misc_feature (1)..(317): Utility: Useful for increasing chlorophyll and photosynthetic capacity
  misc_feature (1)..(317): Utility: Useful for making ornamental plants with modified leaves
  misc_feature (1)..(317): Utility: Useful for making plants with altered leaf shape eg curled leaves
  misc_feature (1)..(317): Utility: Useful for making plants with enhanced tolerance to drought
  misc_feature (1)..(317): Utility: Useful for making plants with increased biomass and foliage
  misc_feature (1)..(317): Utility: Useful for making smaller plants
MASDGSGVVTVYGNNGAALLEPPKQPKSSTFSVKVGLAQMLRGGVIMDVVTPEQARLAEEAGACAVMALERVPADIRAQGGVARMSDPGLIRDIKRAVTIPVMAKARIGHFVEAQILEAVGVDYVDESEVLTPADDAHHINKHNFRVPFVCGCRDLGEALRRVREGAAMIRTKGEAGTGNVVEAVRHVRSVAGAVRALRGMDDDEVFAYAKRIAAPYDLVMQTKQLGRLPVVQFAAGGVATPADAALMMQLGCDGVFVGSGIFKSGDPARRARAIVQAVTHYSDPTILTDVSAGLGEAMVGINLNDPKVERYAARSE

SEQ ID NO: 6347 - protein, 313 aa, Zea mays
  misc_feature (1)..(313): useful for making plants with modified plant phenotypes as described in USSN 12/139,269
  misc_feature (1)..(313): Public GI no. 31429734
  misc_feature (1)..(313): Utility: Useful for increasing chlorophyll and photosynthetic capacity
  misc_feature (1)..(313): Utility: Useful for making ornamental plants with modified leaves
  misc_feature (1)..(313): Utility: Useful for making plants with altered leaf shape eg curled leaves
  misc_feature (1)..(313): Utility: Useful for making plants with enhanced tolerance to drought
  misc_feature (1)..(313): Utility: Useful for making plants with increased biomass and foliage
  misc_feature (1)..(313): Utility: Useful for making smaller plants
MASDGTDVVALYGGANGLSHKSGSFSVKVGLAQMLRGGVIMDVVTPEQARIAEEAGACAVMALERVPADIRAQGGVARMSDPGLIRDIKRSVTIPVMAKARIGHLVEAQILEAIGVDYVDESEVLTLADDAHHINKNNFRVPFVCGCRDLGEALRRIREGAAMIRTKGEAGTGNVVEAVRHVRSVMGDIRALRSMDDDEVFSYAKRIAAPYDLVMQTKQLGRLPVVQFAAGGVATPADAALMMQLGCDGVFVGSGIFKSGDPALRARAIVQAVTHYSDPKILAEVSSGLGEAMVGINLSDPKIHVERFAARSD

SEQ ID NO: 6348 - DNA, 763 bp, Arabidopsis thaliana
  misc_feature (1)..(763): useful for making plants with modified plant phenotypes as described in USSN 12/139,269
  misc_feature (1)..(763): Ceres CLONE ID no. 8916
  misc_feature (1)..(763): Also known as  Ceres CDNA ID no. 23389970
aaaaaaacacaatccctcttagaaacagagagcttctcttctttctccattattcatcactttcttccccgaagatgcgtcctttagacgagaccgagacaaccgtcgtcttcgagaagctcttcaaattcgtcggcaacaacctcaagaagatcgtcgagaacccatcagacgaaggacccgaatctacacccggcagctactgcttccgcctccagaaaaacagagtctactacgtcagcgaagccctcgtgaagcgagccacaaacatctccaggaaaaacctagtctccttcggaacctgcatcgggaaatacactcacgccggtagtttccatctgacgattatgtcactcaatatcttggcggcgaatgctaaacacaaggtatggcttaaacccacttcggagatgtcgtttctttatgggaaccatgtcttgaaaggtggattagggaggattactgatagtattgttcctggagatggtgttgttgtgttctcgatgtctgatgttccgttagggtttgggattgctgcgaagagtacacaggattgtaggaaattggatcctaatggtattgttgtgcttcatcaggctgatattggagagtatttgaggggtgaagatgacctttgaaagtttaaaggttttgtctttgttgtgtcttagtttgattctgcttgttgctttgagttttaaagtatgtagctgttacaagtttcgtggaacttggttctggatctatgaaagtctcgattttt

SEQ ID NO: 6349 - protein, 96 aa, Arabidopsis thaliana
  misc_feature (1)..(96): useful for making plants with modified plant phenotypes as described in USSN 12/139,269
  misc_feature (1)..(96): Utility: Useful for increasing chlorophyll and photosynthetic capacity
  misc_feature (1)..(96): Utility: Useful for making plants sterile and for genetic confinement
  misc_feature (1)..(96): Utility: Useful for making smaller plants
MSLNILAANAKHKVWLKPTSEMSFLYGNHVLKGGLGRITDSIVPGDGVVVFSMSDVPLGFGIAAKSTQDCRKLDPNGIVVLHQADIGEYLRGEDDL

SEQ ID NO: 6350 - protein, 96 aa, Brassica napus
  misc_feature (1)..(96): useful for making plants with modified plant phenotypes as described in USSN 12/139,269
  misc_feature (1)..(96): Ceres CLONE ID no. 945362
  misc_feature (1)..(96): Utility: Useful for increasing chlorophyll and photosynthetic capacity
  misc_feature (1)..(96): Utility: Useful for making plants sterile and for genetic confinement
  misc_feature (1)..(96): Utility: Useful for making smaller plants
  misc_feature (90)..(90): Xaa is any aa, unknown or other
  misc_feature (95)..(95): Xaa is any aa, unknown or other
MSLNLLAANAKHKVWLKPTSEMSFLYGNHVLKGGLGRITDSIVPGDGVVVFSMSDVPLGFGIAAKSTQDCRKLDPNGIVVLHQADIGEYXRDEDXL

SEQ ID NO: 6351 - DNA, 1049 bp, Arabidopsis thaliana
  misc_feature (1)..(1049): useful for making plants with modified plant phenotypes as described in USSN 12/139,269
  misc_feature (1)..(1049): Ceres CLONE ID no. 10879
  misc_feature (1)..(1049): Also known as  Ceres CDNA ID no. 23646526
aactgccaaaactcttcacttaattctccggcgtatacaagtcgccggcaaaaatgtcgatgtcgaaaagctccaagatgcttcagttcataaactacaggatgcgagtaacaatccaagacggaagacagctaatcggaaaattcatggcgttcgatcgccacatgaatcttgttcttggcgactgcgaagagtttcgaaaacttcctccggcgaaaggtaataagaagacgagcgaagaaagagaagagcgtcgtactctaggtttggttttacttagaggagaagaagtgatttcgatgactgtcgaaggtccaccgccaccggaagaatctcgcgccaaatctggatctgttaccgccgtggctggtcctggaatcggtcgtgctgctggacgcggagtacctactggtccgttagttcaagctcagcctggtttatctggtcctgttcgtggaattggtggacctgctcctggaatgatgcagcctcagatctctagaccaccacagattattcgtcctccgggacaaatgccaccacagcctccttttgctggtcaaggaggtcctcctccaccttatggtatgagaccaccgtatcctggtccaccaccgcctcagtatggtggacagcaaaggccaatgatgattcctccacctggtggtatgatgagaggacctcctccacctcatggtatgcaaggaccgcctccttctcgccctggaatacctccccccggtggtgctccgatgtttgctccgcctcatcctggcatgccacctgctccgccaaatcaccataatcagcaacattgattaggagtcacttcatctacaacgaaagcaacatccacatgattgagttacccctcggctagtcgtagcgtttttctccgtgaagctcagagaattgatgagttcatattggtgatttctcgtggaaaaagcaactgattttagaaatagtgaacttgtaggagttacaaccttgctccatgaacttgaatgtattacttgtaaaagaggctctcaatggttttgactggc

SEQ ID NO: 6352 - protein, 254 aa, Arabidopsis thaliana
  misc_feature (1)..(254): useful for making plants with modified plant phenotypes as described in USSN 12/139,269
  misc_feature (7)..(85): Pfam Name: LSM; Pfam Description: LSM domain
  misc_feature (1)..(254): Utility: Useful for increasing chlorophyll and photosynthetic capacity
  misc_feature (1)..(254): Utility: Useful for making ornamental plants with modified leaves
  misc_feature (1)..(254): Utility: Useful for making plants with increased biomass and foliage
  misc_feature (1)..(254): Utility: Useful for making smaller plants
  misc_feature (1)..(254): Utility: Useful for making stronger plants
MSMSKSSKMLQFINYRMRVTIQDGRQLIGKFMAFDRHMNLVLGDCEEFRKLPPAKGNKKTSEEREERRTLGLVLLRGEEVISMTVEGPPPPEESRAKSGSVTAVAGPGIGRAAGRGVPTGPLVQAQPGLSGPVRGIGGPAPGMMQPQISRPPQIIRPPGQMPPQPPFAGQGGPPPPYGMRPPYPGPPPPQYGGQQRPMMIPPPGGMMRGPPPPHGMQGPPPSRPGIPPPGGAPMFAPPHPGMPPAPPNHHNQQH

SEQ ID NO: 6353 - protein, 257 aa, Arabidopsis thaliana
  misc_feature (1)..(257): useful for making plants with modified plant phenotypes as described in USSN 12/139,269
  misc_feature (1)..(257): Ceres CLONE ID no. 205653
  misc_feature (1)..(257): Utility: Useful for increasing chlorophyll and photosynthetic capacity
  misc_feature (1)..(257): Utility: Useful for making ornamental plants with modified leaves
  misc_feature (1)..(257): Utility: Useful for making plants with increased biomass and foliage
  misc_feature (1)..(257): Utility: Useful for making smaller plants
  misc_feature (1)..(257): Utility: Useful for making stronger plants
MSMSKSSKMLQFINYRMRVTIQDGRQLVGKFMAFDRHMNLVLGDCEEFRKLPPAKGKKINEEREDRRTLGLVLLRGEEVISMTVEGPPPPEESRAKAGSAAAVAGPGIGRAAGRGVPTGPLVQAQPGLSGPVRGVGGPAPGMMQPQISRPPQLSAPPIIRPPGQMLPPPPFGGQGPPMGRGPPPPYGMRPPPQQFSGPPPPQYGQRPMIPPPGGMMRGPPPPLHGMQGPPPPRPGMPPAPGGFAPPRPGMPPHNQQQ

SEQ ID NO: 6354 - protein, 176 aa, Arabidopsis thaliana
  misc_feature (1)..(176): useful for making plants with modified plant phenotypes as described in USSN 12/139,269
  misc_feature (1)..(176): Ceres CLONE ID no. 36005
  misc_feature (1)..(176): Utility: Useful for increasing chlorophyll and photosynthetic capacity
  misc_feature (1)..(176): Utility: Useful for making ornamental plants with modified leaves
  misc_feature (1)..(176): Utility: Useful for making plants with increased biomass and foliage
  misc_feature (1)..(176): Utility: Useful for making smaller plants
  misc_feature (1)..(176): Utility: Useful for making stronger plants
MTVEGPPPPEESRAKAGSAAAVAGPGIGRAAGRGVPTGPLVQAQPGLSGPVRGVGGPAPGMMQPQISRPPQLSAPPIIRPPGQMLPPPPFGGQGPPMGRGPPPPYGMRPPPQQFSGPPPPQYGQRPMIPPPGGMMRGPPPPPHGMQGPPPPRPGMPPAPGGFAPPRPGMPPHNQQQ

SEQ ID NO: 6355 - protein, 251 aa, Zea mays
  misc_feature (1)..(251): useful for making plants with modified plant phenotypes as described in USSN 12/139,269
  misc_feature (1)..(251): Ceres CLONE ID no. 1375012
  misc_feature (1)..(251): Utility: Useful for increasing chlorophyll and photosynthetic capacity
  misc_feature (1)..(251): Utility: Useful for making ornamental plants with modified leaves
  misc_feature (1)..(251): Utility: Useful for making plants with increased biomass and foliage
  misc_feature (1)..(251): Utility: Useful for making smaller plants
  misc_feature (1)..(251): Utility: Useful for making stronger plants
MSMSKSSKMLQFINYRMRVTIQDGRQLVGKFMAFDRHMNLVLGDCEEFRKLPPGKGKKINEEREERRTLGLVLLRGEEVISMTVKGPPPPEESRAKAGSAAALAGPGVGRAAGRGVPTGPLVQAQPGLSGPVRGVGGPSPGMMQPQISRPPVMRPPGQMLPPPPAFGGQGPPMGRGPPPPAYGGMRPQFGGPPPPYGQRPMGPPPGGMMMRGPPPPPHGMQGPPPPRPPPGGFAPRPGMQGPPPPQHNQQQ

SEQ ID NO: 6356 - protein, 281 aa, Glycine max
  misc_feature (1)..(281): useful for making plants with modified plant phenotypes as described in USSN 12/139,269
  misc_feature (1)..(281): Ceres CLONE ID no. 519929
  misc_feature (1)..(281): Utility: Useful for increasing chlorophyll and photosynthetic capacity
  misc_feature (1)..(281): Utility: Useful for making ornamental plants with modified leaves
  misc_feature (1)..(281): Utility: Useful for making plants with increased biomass and foliage
  misc_feature (1)..(281): Utility: Useful for making smaller plants
  misc_feature (1)..(281): Utility: Useful for making stronger plants
  misc_feature (120)..(120): Xaa is any aa, unknown or other
MSMSKSSKMLQYINYRMRVTIQDGRQLVGKFMAFDRHMNLVLGDCEEFRKLPPAKGKKPAEGGDREDRRTLGLVLLRGEEVISMTVEGPPPPEESRSKAVGAAALAGPGIGRAAGRGIPXAPVVQAQPGLAGPVRGMGGPAPGMMQPQISRPPQLNAPPVSYPGGGPPVMRPPGQMPGQFAPPPMARGPPPPMPPGQFAPQRPGGPPPQFQVPPQFGQRPMGPPPPGQMVRGPPAPPRPGMPAPPPPRPGMPPPPGSGVPVFGPPRPGMPPPPNPPNQQQQ

SEQ ID NO: 6357 - protein, 265 aa, Triticum aestivum
  misc_feature (1)..(265): useful for making plants with modified plant phenotypes as described in USSN 12/139,269
  misc_feature (1)..(265): Ceres CLONE ID no. 759040
  misc_feature (1)..(265): Utility: Useful for increasing chlorophyll and photosynthetic capacity
  misc_feature (1)..(265): Utility: Useful for making ornamental plants with modified leaves
  misc_feature (1)..(265): Utility: Useful for making plants with increased biomass and foliage
  misc_feature (1)..(265): Utility: Useful for making smaller plants
  misc_feature (1)..(265): Utility: Useful for making stronger plants
MSNPKGSKMLQFVNYRMRVTIQDGRQLVGKFMAFDRHMNLVLGDCEEFRKLPPSKSSKTTGEREERRTLGLLLLRGEEVVSMTVEGPPPPDESRAKASAGVAALSGTGVGRAAGRGVATGPLLQAQPGLSGPVRGVGGPAPGMMQPQISRPPMPNLSAPPVAYPQVVRPPPMGMPPMRPGGPPPMQMQFQRPPGPPPAPYPGAPPQQFMRGPPPMGPPPGRPGMPSMPPPPGMRPMPPTQFGQPPRHGMPPPPPGPQQPGQNPQQ

SEQ ID NO: 6358 - protein, 261 aa, Triticum aestivum
  misc_feature (1)..(261): useful for making plants with modified plant phenotypes as described in USSN 12/139,269
  misc_feature (1)..(261): Public GI no. 50934399
  misc_feature (1)..(261): Utility: Useful for increasing chlorophyll and photosynthetic capacity
  misc_feature (1)..(261): Utility: Useful for making ornamental plants with modified leaves
  misc_feature (1)..(261): Utility: Useful for making plants with increased biomass and foliage
  misc_feature (1)..(261): Utility: Useful for making smaller plants
  misc_feature (1)..(261): Utility: Useful for making stronger plants
MSNPKGSKMLQFVNYRMRVTIQDGRQLVGKFMAFDRHMNLVLGDCEEFRKLPPSKSSKTTGEREERRTLGLLLLRGEEVVSMTVEGPPPPDESRAKAAGAGAAMAGPGVGRAAGRGVPAGQMLQAQPGLAGPVRGVGGPAPGMMQPQISRPPMPNLSAPPVAYPQVVRPPPGQMPPPMRPPQMPIPFQRPPGVPPAFPGGPPPPPGPFMRGPPPMGPPQVRPGMPGGPPPGMRPGMPPPPFRPGMPPPPPGPQQPGQNPPQ

SEQ ID NO: 6359 - DNA, 1457 bp, Arabidopsis thaliana
  misc_feature (1)..(1457): useful for making plants with modified plant phenotypes as described in USSN 12/139,269
  misc_feature (1)..(1457): Ceres CLONE ID no. 19116
  misc_feature (1)..(1457): Also known as  Ceres CDNA ID no. 23369541
gtggtaaattagtcagatttcgatttggaaccctaaaaaaattcaaaagacgatcctcttctcgaagaaactcgattcttgtggattcgatttcattaaggaattttgaattgttgcctgtgatgggtggtttggctatggaggaaatgcctttatcggtgctattcgagcaagctaggaaaattcatcttgctgcttcagagtctggtgttgatcaggatgttgtgaagaaaggatgtgagatgtttcagaagtgcgaagatatgatcgggaagctggcgctgttttcgtctaacgagactaaagaagatattagcaccaacaatctcaaatatcttttggtgccttattatcttgcggagttgacagagaaaatcatacaggaggaccggattcagattgtcaaagcctcgtatgctaagttgaaggagttcttttcgttctgtgaggcaatggagcttgttccggatgaggagttggaggcttcttcacgaggaggttctggtgcacctgctgatcgaagggctctcaagatagctcggttcaaacgtcaaaaggctgcagaggcaaagcttcttgaaattaaagagaggaaggagcgacgtggacgttccactaaagcatcagctttgtcgactccggttgaatctggagaagatgatattccagatgatgacagcgaagaagagagagaggcctggctctcctcaattaacttggctatttgtaaggctattgatctgttggaaatgctaaagagagaagaggaaatgctctctgcaataaaggaaagacagttgaaggatggagagggtggattttctcgggatgctcttgatgatcgtacaaagaaagctgaaacctggcacagagacgctgctgcaaggatacagtactctaaaccggcacaaccaatcacttgtgccacatttgcacaagatgtgttagaaggaagagcttcggtatcacaaggtcacgaacacaagaaccaacctcttatattcggtccagcaagcatcgtgggtggaccgctctctaccgagagagaaagaatgatagctcaggtcttccaaccaagtcacaggatgccaacaatgtgcatagaggatgctgggttaacagagatgaacataatgaatgattggcaagagcagacgaaaaaagccattgaagaagcaaccacctcatggtacaatgataaacctctaagaagaaaagaagaagacgaggaagatgatgatgaagacgacgaacctgtgatgaaagctagagctttcgatgattggaaggatgataatcctcgcggtgcaggtaacaagaaactcacaccttgtggctgagactagagaccgagacacacattatttaacactttctccctctcttttgtttcttatttccaaaacctcttcgttcacttattataatgtctgtaatgtaatcatctttctactctt

SEQ ID NO: 6360 - protein, 405 aa, Arabidopsis thaliana
  misc_feature (1)..(405): useful for making plants with modified plant phenotypes as described in USSN 12/139,269
  misc_feature (9)..(393): Pfam Name: TAP42; Pfam Description: TAP42-like family
  misc_feature (1)..(405): Utility: Useful for increasing chlorophyll and photosynthetic capacity
  misc_feature (1)..(405): Utility: Useful for making plants with increased biomass and foliage
  misc_feature (1)..(405): Utility: Useful for making shorter plants and plants with modified flowers
  misc_feature (1)..(405): Utility: Useful for making smaller plants
  misc_feature (1)..(405): Utility: Useful for making stronger plants
MGGLAMEEMPLSVLFEQARKIHLAASESGVDQDVVKKGCEMFQKCEDMIGKLALFSSNETKEDISTNNLKYLLVPYYLAELTEKIIQEDRIQIVKASYAKLKEFFSFCEAMELVPDEELEASSRGGSGAPADRRALKIARFKRQKAAEAKLLEIKERKERRGRSTKASALSTPVESGEDDIPDDDSEEEREAWLSSINLAICKAIDLLEMLKREEEMLSAIKERQLKDGEGGFSRDALDDRTKKAETWHRDAAARIQYSKPAQPITCATFAQDVLEGRASVSQGHEHKNQPLIFGPASIVGGPLSTERERMIAQVFQPSHRMPTMCIEDAGLTEMNIMNDWQEQTKKAIEEATTSWYNDKPLRRKEEDEEDDDEDDEPVMKARAFDDWKDDNPRGAGNKKLTPCG

SEQ ID NO: 6361 - protein, 413 aa, Arabidopsis thaliana
  misc_feature (1)..(413): useful for making plants with modified plant phenotypes as described in USSN 12/139,269
  misc_feature (1)..(413): Public GI no. 8809589
  misc_feature (1)..(413): Utility: Useful for increasing chlorophyll and photosynthetic capacity
  misc_feature (1)..(413): Utility: Useful for making plants with increased biomass and foliage
  misc_feature (1)..(413): Utility: Useful for making shorter plants and plants with modified flowers
  misc_feature (1)..(413): Utility: Useful for making smaller plants
  misc_feature (1)..(413): Utility: Useful for making stronger plants
MGGLAMEEMPLSVLFEQARKIHLAASESGVDQDVVKKGCEMFQKCEDMIGKLALFSSNETKEDISTNNLKYLLVPYYLAELTEKIIQEDRIQIVKASYAKLKEFFSFCEAMELVPDEELEASSRGGSGAPADRRALKIARFKRQKAAEAKLLEIKERKERRGRSTKASALSTPVESGEDDIPDDDSEEERELSCLIAFLCRPGSPQLTWLFAIDLLEMLKREEEMLSAIKERQLKDGEGGFSRDALDDRTKKAETWHRDAAARIQYSKPAQPITCATFAQDVLEGRASVSQGHEHKNQPLIFGPASIVGGPLSTERERMIAQVFQPSHRMPTMCIEDAGLTEMNIMNDWQEQTKKAIEEATTSWYNDKPLRRKEEDEEDDDEDEEAVMKARAFDDWKDDNPRGAGNKKLTPCG

SEQ ID NO: 6362 - protein, 418 aa, Arabidopsis thaliana
  misc_feature (1)..(418): useful for making plants with modified plant phenotypes as described in USSN 12/139,269
  misc_feature (1)..(418): Public GI no. 29367365
  misc_feature (1)..(418): Utility: Useful for increasing chlorophyll and photosynthetic capacity
  misc_feature (1)..(418): Utility: Useful for making plants with increased biomass and foliage
  misc_feature (1)..(418): Utility: Useful for making shorter plants and plants with modified flowers
  misc_feature (1)..(418): Utility: Useful for making smaller plants
  misc_feature (1)..(418): Utility: Useful for making stronger plants
MVEVEEVSNKMQAQMRLHPAAAAEEEDADLPLPALFDKASHLHSLASSSSLDQEGIRKGVDLLRRCDEMVSKLGLFSSNETKDDVSTANLKYLLVPYYLGEMTERVAQEDRIPVLKASQDHLKEFISICEALELISEDELELSRQKQPDTMANRRAQKAARFKRQKAAETKLLEIKERKERRRRSLRAAALSAPIEAGEEDAFEDDGEEEREAWLATISLALCKAFDLLDMLKKEEEMLLAVKERQAKDGNAFAREMLDERTKKAEAWHHNAANRAPYSKPADPITCATFAQDVIEGRASVSQAHEHKHQPLIFGPASLVGGGLTSERERMAAQVFQPSYRLPTMSIEEAGLREMKMMEKWQERTAKMIQESNSAWHKDGSRSAQEDEDAEEEKARAWDDWKDDNPRGAGNKKLTPCG

SEQ ID NO: 6363 - protein, 416 aa, Zea mays
  misc_feature (1)..(416): useful for making plants with modified plant phenotypes as described in USSN 12/139,269
  misc_feature (1)..(416): Ceres CLONE ID no. 325957
  misc_feature (1)..(416): Utility: Useful for increasing chlorophyll and photosynthetic capacity
  misc_feature (1)..(416): Utility: Useful for making plants with increased biomass and foliage
  misc_feature (1)..(416): Utility: Useful for making shorter plants and plants with modified flowers
  misc_feature (1)..(416): Utility: Useful for making smaller plants
  misc_feature (1)..(416): Utility: Useful for making stronger plants
MVDVEETGNKLQSQMRLHAEPEDDAADLPLPALFDRASRLHALASSSALDQDGIRTGVDLLRRCDDMVSKLGLFSPNETKEDVSTANLKYLLVPYYLAEMTEKIAQEDRIPVLKTSQDHLKEFIALCEVLELIPEDELELSRQKQPDTLTNRRAQKVARFKRQKAAETKLQEIRERKERRGRSLRAAALSAPIEAGEEDDLENDGEEEREAWLATISLALCKAFDLLDMLKKEEEMLQAVKERKAKDGNAFAREMLDERTKKAETWHHNAANRVAYSKPADPITCATFAQDVIEGRASVSQAHEHKHQPLIFGPASIVGGGLTSERERMTAQVFQPSYRMPTMSIEEAGLREMKMMEKWQERTAEVMKESTSAWHKDGSSSAQEDEDAEEEKARAWDDWKDDNPRGAGNKKLTPCG

SEQ ID NO: 6364 - protein, 379 aa, Zea mays
  misc_feature (1)..(379): useful for making plants with modified plant phenotypes as described in USSN 12/139,269
  misc_feature (1)..(379): Public GI no. 984756
  misc_feature (1)..(379): Utility: Useful for increasing chlorophyll and photosynthetic capacity
  misc_feature (1)..(379): Utility: Useful for making plants with increased biomass and foliage
  misc_feature (1)..(379): Utility: Useful for making shorter plants and plants with modified flowers
  misc_feature (1)..(379): Utility: Useful for making smaller plants
  misc_feature (1)..(379): Utility: Useful for making stronger plants
MVEVEEVSNKMQVQMRLHPAAAAEEEDADLPLPALFDKASHLHSLASSSSLDQEGIRKGVDLLRRCDEMVSKVGLFSSNETKDDISTANLKYLLVPYYLGEMTERVAQEDRIPVLKASQDHLKEFISICEALELISEDELEISRQKNLIPWQIEEHRRLHGSSAKRLQKQSSRIKERKERRRRHESSCLSAPIELGGDLLRMMEKEREGMVSYYLIGSIEGFDLLDMLKKEEEIVPAVKEGKRRMVMHLLVKCLMNVQKGLKHGTIMLPTVHHTPNQLIQSLVQLTSERERMAAQVFQPSYRLPTMSIEEAGLREMKMMEKWQERTAKMIQESNSAWHKDGSRSAQEDEDAEEEKARGWDDWKDDNPRGAGNKKLTPCG

SEQ ID NO: 6365 - DNA, 780 bp, Arabidopsis thaliana
  misc_feature (1)..(780): useful for making plants with modified plant phenotypes as described in USSN 12/139,269
  misc_feature (1)..(780): Ceres CLONE ID no. 19319
  misc_feature (1)..(780): Also known as  Ceres CDNA ID no. 23471366
atagttttatatcatatcaatcgacatggcgaatgtggaccgtgatcggcgtgtgcatgtagaccgtactgacaaacgtgttcatcagccaaactacgaagatgatgtcggttttggtggctatggcggttatggtgctggttctgattataagagtcgcggcccctccactaaccaaatcttggcacttatagcaggagttcccattggtggcacactgctaaccctagctggactcactctagccggttcggtgatcggcttgctagtctccatacccctcttcctcctcttcagtccggtgatagtcccggcggctctcactattgggcttgctgtgacgggaatcttggcttctggtttgtttgggttgacgggtctgagctcggtctcgtgggtcctcaactacctccgtgggacgagtgatacagtgccagagcaattggactacgctaaacggcgtatggctgatgcggtaagctatgctggtatgaagggaaaagagatgggtcagtatgtgcaagataaggcgcatgaggctcgtgagactgagttcatgactgagacccatgagccgggtaaggccaggagaggctcataagctaatataaattgcgggagtcagttggaaaggcgataaatgtagttttacttttatgttccagtttctttcctcttttaagaatatctttgtctatatgtgtacgttcgttttgtcttgtccaaataaaaatccttgttagtgaaataagaaatgaaataaatatgttttcttttttg

SEQ ID NO: 6366 - protein, 191 aa, Arabidopsis thaliana
  misc_feature (1)..(191): useful for making plants with modified plant phenotypes as described in USSN 12/139,269
  misc_feature (48)..(165): Pfam Name: Oleosin; Pfam Description: Oleosin
  misc_feature (1)..(191): Utility: Useful for increasing chlorophyll and photosynthetic capacity
  misc_feature (1)..(191): Utility: Useful for making plants with enhanced abiotic stress tolerance
  misc_feature (1)..(191): Utility: Useful for making smaller plants
  misc_feature (160)..(160): Xaa is any aa, unknown or other
MANVDRDRRVHVDRTDKRVHQPNYEDDVGFGGYGGYGAGSDYKSRGPSTNQILALIAGVPIGGTLLTLAGLTLAGSVIGLLVSIPLFLLFSPVIVPAALTIGLAVTGILASGLFGLTGLSSVSWVLNYLRGTSDTVPEQLDYAKRRMADAVSYAGMKGKXMGQYVQDKAHEARETEFMTETHEPGKARRGS

SEQ ID NO: 6367 - protein, 140 aa, Glycine max
  misc_feature (1)..(140): useful for making plants with modified plant phenotypes as described in USSN 12/139,269
  misc_feature (1)..(140): Ceres CLONE ID no. 1171110
  misc_feature (1)..(140): Utility: Useful for increasing chlorophyll and photosynthetic capacity
  misc_feature (1)..(140): Utility: Useful for making plants with enhanced abiotic stress tolerance
  misc_feature (1)..(140): Utility: Useful for making smaller plants
MSLTGSQLLALLAGVPLGAMLLLLSGISLIASLLGLAVATPLFIFFSPLLVPAAFAIGMAVTAVLAAGACGLAGLVLFSWVVNYLRQMPRGTTMMTVLPEQAKRHVADMAEYVGQKTKEVGQDIQTRAHHAQGTTRMTVH

SEQ ID NO: 6368 - protein, 186 aa, Zea mays
  misc_feature (1)..(186): useful for making plants with modified plant phenotypes as described in USSN 12/139,269
  misc_feature (1)..(186): Ceres CLONE ID no. 1286956
  misc_feature (1)..(186): Utility: Useful for increasing chlorophyll and photosynthetic capacity
  misc_feature (1)..(186): Utility: Useful for making plants with enhanced abiotic stress tolerance
  misc_feature (1)..(186): Utility: Useful for making smaller plants
MADRDRSGIYGGAHATYGQQQQQGGGGRPMGEQVKGMLHDKGPTASQALTVATLFPLGGLLLVLSGLALTASVVGLAVATPVFLIFSPVLVPAALLIGTAVMGFLTSGALGLGGLSSLTCLANTARQAFQRTPDYVEEAHRRMAEAAAHAGHKTAQAGQAIQGRAQEAGAGGGAGAGAGGGGRASS

SEQ ID NO: 6369 - protein, 176 aa, Zea mays
  misc_feature (1)..(176): useful for making plants with modified plant phenotypes as described in USSN 12/139,269
  misc_feature (1)..(176): Ceres CLONE ID no. 290537
  misc_feature (1)..(176): Utility: Useful for increasing chlorophyll and photosynthetic capacity
  misc_feature (1)..(176): Utility: Useful for making plants with enhanced abiotic stress tolerance
  misc_feature (1)..(176): Utility: Useful for making smaller plants
MADRDRSGIYGGGAYGQQQGGGRPMGEQVKGMIHDKGPTASQALTVATLFPLGGLLLVLSGLALAASTVGLALATPVFLLFSPVLVPAALLIGTAVAGFLTSGALGLGGLSSLTCLANTARQAFQRTPDYVEEARRRMAEAAAHAGHKTAQAGHGIQSKAQEAGAGTGAGGGRTSS

SEQ ID NO: 6370 - protein, 176 aa, Zea mays; identical to SEQ ID NO: 6369
  misc_feature (1)..(176): useful for making plants with modified plant phenotypes as described in USSN 12/139,269
  misc_feature (1)..(176): Ceres CLONE ID no. 1283332
  misc_feature (1)..(176): Utility: Useful for increasing chlorophyll and photosynthetic capacity
  misc_feature (1)..(176): Utility: Useful for making plants with enhanced abiotic stress tolerance
  misc_feature (1)..(176): Utility: Useful for making smaller plants

SEQ ID NO: 6371 - protein, 176 aa, Zea mays
  misc_feature (1)..(176): useful for making plants with modified plant phenotypes as described in USSN 12/139,269
  misc_feature (1)..(176): Ceres CLONE ID no. 1277502
  misc_feature (1)..(176): Utility: Useful for increasing chlorophyll and photosynthetic capacity
  misc_feature (1)..(176): Utility: Useful for making plants with enhanced abiotic stress tolerance
  misc_feature (1)..(176): Utility: Useful for making smaller plants
MADRDRSGIYGGGAYGQQQGGGRPMGEQVKGMIHDKGPTASQALTVATLFPLGGLLLVLSGLALAASTVGLALATPVFLLFSPALVPAALLIGTAVAGFLTSGALGLGGLSSLTCLANTARQAFQRTPDYVEEARRRMAEAAAHAGHKTAQAGHGIQSKAQEAGAGTGAGGGRTSS

SEQ ID NO: 6372 - protein, 192 aa, Triticum aestivum
  misc_feature (1)..(192): useful for making plants with modified plant phenotypes as described in USSN 12/139,269
  misc_feature (1)..(192): Ceres CLONE ID no. 698804
  misc_feature (1)..(192): Utility: Useful for increasing chlorophyll and photosynthetic capacity
  misc_feature (1)..(192): Utility: Useful for making plants with enhanced abiotic stress tolerance
  misc_feature (1)..(192): Utility: Useful for making smaller plants
  misc_feature (144)..(144): Xaa is any aa, unknown or other
MADRGGYVQVQHGQYGGGHHGGQQQHGRQMGEQMKGMFQEKALTVATLFPLGGLLLVLSGLALAGTVVGLAVATPVFLLFSPMLVPAALTIGLAVTGFLTSGALGLGGLSSLTVLANTARQAFQRTPDYVEEARQRMADAAAAXGHKDAAGRPRHPEPRGGRARRRRWPHRRHRRSGRRHRHRHQGVVVSWS

SEQ ID NO: 6373 - DNA, 1391 bp, Arabidopsis thaliana
  misc_feature (1)..(1391): useful for making plants with modified plant phenotypes as described in USSN 12/139,269
  misc_feature (1)..(1391): Ceres CLONE ID no. 19486
  misc_feature (1)..(1391): Also known as  Ceres CDNA ID no. 23357765
atcaaataataatagtgtaattaagtcggaggaaaacaacaagaacccagaaagaggaacgaagaaactaattcaaaggatcaagttcaccgcttcattttagtcattaaacaaagatggtgatgggaggagaagcatccatggaactggaccagtgttttcagaagatgaagatggaaggaatctcgatcaaagagtggaaagatatccctgtggagcttctgatgaggatcctttcccttgttgatgatcgtaatgtcattgttgcttctggtgtttgcactggctggagagatgctatctcttttggcctcactcgtctccgtctctcttggtgcaacaacaacatgaacagcttggttctttctcttgttcccaagtttgtaaagctgcagactttaaatctaaggcaggacaaaccgcaactagaggacaatgcagtggaggccatagcaaatcactgccatgagttacaagaacttgatctcagcaaaagcttgaaaattacagaccgttcactttatgcacttgctcatggttgcccagacctcacaaaactcaaccttagtggctgcacttcattcagcgacactgctattgcgtatttgaccagattctgcagaaagcttaaagttttgaatctttgcggatgtgtcaaagctgtaactgacaatgccttggaggctattgggaataactgcaatcagatgcagtcactaaacttgggatggtgtgagaatatcagtgatgatggggtaatgagtttagcttatggctgtccagatctcaggacccttgacctctgcggctgtgttcttattacagatgagagtgtggtagctctagcagactggtgtgtccacttgaggtcactggggctatactattgcagaaacataacagacagagcaatatactcgctagctcaaagcggggtaaagaacaaaccgggatcgtggaaatcggttaagaaaggtaaatacgatgaagaaggactgagaagtctcaacattagccaatgcactgcccttacatcttcagcggttcaagctgtttgcgattcatttcccgcacttcacacatgctcaggaaggcattcgcttgtcatgagcggctgtctgaacttaacaactgtgcactgtgcttgtatccttcaggctcatcgtgcacacaatgcggttcctcatcctgctcattaagacagaggaatagttatgttgtatatataaacatcatgttgatggagattagtattataaacgaagtagcttttttaaggtttatgtgaaaccttagaagcttttgagttgttctttctttgtcttgaaagatcttttgtatattttggtgctatgttcataacttctttagtaagacctctcgttgttacc

SEQ ID NO: 6374 - protein, 360 aa, Arabidopsis thaliana
  misc_feature (1)..(360): useful for making plants with modified plant phenotypes as described in USSN 12/139,269
  misc_feature (293)..(321): Pfam Name: LRR_1; Pfam Description: Leucine Rich Repeat
  misc_feature (28)..(73): Pfam Name: F-box; Pfam Description: F-box domain
  misc_feature (1)..(360): Utility: Useful for increasing chlorophyll and photosynthetic capacity
  misc_feature (1)..(360): Utility: Useful for making larger plants
  misc_feature (1)..(360): Utility: Useful for making ornamental plants with modified leaves
  misc_feature (1)..(360): Utility: Useful for making plants with altered leaf shape eg curled leaves
  misc_feature (1)..(360): Utility: Useful for making plants with increased biomass and foliage
  misc_feature (1)..(360): Utility: Useful for making smaller plants
MVMGGEASMELDQCFQKMKMEGISIKEWKDIPVELLMRILSLVDDRNVIVASGVCTGWRDAISFGLTRLRLSWCNNNMNSLVLSLVPKFVKLQTLNLRQDKPQLEDNAVEAIANHCHELQELDLSKSLKITDRSLYALAHGCPDLTKLNLSGCTSFSDTAIAYLTRFCRKLKVLNLCGCVKAVTDNALEAIGNNCNQMQSLNLGWCENISDDGVMSLAYGCPDLRTLDLCGCVLITDESVVALADWCVHLRSLGLYYCRNITDRAIYSLAQSGVKNKPGSWKSVKKGKYDEEGLRSLNISQCTALTSSAVQAVCDSFPALHTCSGRHSLVMSGCLNLTTVHCACILQAHRAHNAVPHPAH

SEQ ID NO: 6375 - protein, 343 aa, Arabidopsis thaliana
  misc_feature (1)..(343): useful for making plants with modified plant phenotypes as described in USSN 12/139,269
  misc_feature (1)..(343): Ceres CLONE ID no. 3549
  misc_feature (1)..(343): Utility: Useful for increasing chlorophyll and photosynthetic capacity
  misc_feature (1)..(343): Utility: Useful for making larger plants
  misc_feature (1)..(343): Utility: Useful for making ornamental plants with modified leaves
  misc_feature (1)..(343): Utility: Useful for making plants with altered leaf shape eg curled leaves
  misc_feature (1)..(343): Utility: Useful for making plants with increased biomass and foliage
  misc_feature (1)..(343): Utility: Useful for making smaller plants
MKMEGVLISEWKDIPVELLMKILNLVDDRTVIIASCICSGWRDAVSLGLTRLSLSWCKKNMNSLVLSLAPKFVKLQTLVLRQDKPQLEDNAVEAIANHCHELQDLDLSKSSKITDHSLYSLARGCTNLTKLNLSGCTSFSDTALAHLTRFCRKLKILNLCGCVEAVSDNTLQAIGENCNQLQSLNLGWCENISDDGVMSLAYGCPDLRTLDLCSCVLITDESVVALANRCIHLRSLGLYYCRNITDRAMYSLAQSGVKNKHEMWRAVKKGKFDEEGLRSLNISQCTYLTPSAVQAVCDTFPALHTCSGRHSLVMSGCLNLQSVHCACILQAHRTHTVYPHPAH

SEQ ID NO: 6376 - protein, 352 aa, Glycine max
  misc_feature (1)..(352): useful for making plants with modified plant phenotypes as described in USSN 12/139,269
  misc_feature (1)..(352): Ceres CLONE ID no. 472861
  misc_feature (1)..(352): Utility: Useful for increasing chlorophyll and photosynthetic capacity
  misc_feature (1)..(352): Utility: Useful for making larger plants
  misc_feature (1)..(352): Utility: Useful for making ornamental plants with modified leaves
  misc_feature (1)..(352): Utility: Useful for making plants with altered leaf shape eg curled leaves
  misc_feature (1)..(352): Utility: Useful for making plants with increased biomass and foliage
  misc_feature (1)..(352): Utility: Useful for making smaller plants
MMVAGSGNGEKGVNSKVGVITEWKDIPVELLMQILSLVDDQTVITASGVCRGWRDAIYFGLARLSLSWCSKSMNNLVLSLVPKFVKLQTLILRQDKPQLEDNAVETIAKCCHELQILDLSKSFKLTDHSLYELALGCRDLTKLNISGCSAFSDNALAYLASFCRKLKVLNLCGCVRAASDTALQAIGQYCNQLQSLNLGWCDNVGDVGVTTLAYGCPDLRIVDLCGCVRITDDSVIALATRCPHLRSLGLYYCKNITDRAMYSLAHSKVNNRMWGSVKGGNDEDGLRTLNISQCTALTPSAVQAVCDSFPSLHTCSGRHSLIMSGCLNLTSVHCACAVHAHRAFTTFPHPAH

SEQ ID NO: 6377 - protein, 351 aa, Zea mays
  misc_feature (1)..(351): useful for making plants with modified plant phenotypes as described in USSN 12/139,269
  misc_feature (1)..(351): Ceres CLONE ID no. 1446800
  misc_feature (1)..(351): Utility: Useful for increasing chlorophyll and photosynthetic capacity
  misc_feature (1)..(351): Utility: Useful for making larger plants
  misc_feature (1)..(351): Utility: Useful for making ornamental plants with modified leaves
  misc_feature (1)..(351): Utility: Useful for making plants with altered leaf shape eg curled leaves
  misc_feature (1)..(351): Utility: Useful for making plants with increased biomass and foliage
  misc_feature (1)..(351): Utility: Useful for making smaller plants
MVTSSSERGQAGSGGPAPTLTGWKDLPMELLVRIISTVGDDRMVIVASGVCTGWRDALGWGVTNLSLTWCKLSMNNLMISLAHKFTKLQVLTLRQNKPQLEDSAVEAVANYCHDLRELDLSRSFRLSDRSLYALAHGCPRLTRLNISGCSSFSDTALIYLTCRCKNLKCLNLCGCVKAVTDRALQAIAQNCGQLQSLNLGWCDDVTDKGVTSLASGCPDLRAVDLCGCVLITDESVVALANGCPHLRSLGLYFCQNITDRAMYSLANSRVKSKRGRWDAVKDGLANLNISQCTALTPPAVQAVCDSFPALHTCPERHSLIISGCLSLTSVHCACALHPHRAGRALMANHAY

SEQ ID NO: 6378 - protein, 351 aa, Zea mays
  misc_feature (1)..(351): useful for making plants with modified plant phenotypes as described in USSN 12/139,269
  misc_feature (1)..(351): Ceres CLONE ID no. 239171
  misc_feature (1)..(351): Utility: Useful for increasing chlorophyll and photosynthetic capacity
  misc_feature (1)..(351): Utility: Useful for making larger plants
  misc_feature (1)..(351): Utility: Useful for making ornamental plants with modified leaves
  misc_feature (1)..(351): Utility: Useful for making plants with altered leaf shape eg curled leaves
  misc_feature (1)..(351): Utility: Useful for making plants with increased biomass and foliage
  misc_feature (1)..(351): Utility: Useful for making smaller plants
MVTSSSERGQAGSGGPAPTLTGWKDLPMELLVRIISTVGDDRMVIVASGVCTGWRDALGWGVTNLSLTWCKLSMNNLMISLAHKFTKLQVLTLRQNKPQLEDSAVEAVANYCHDLRELDLSRSFRLSDRSLYALAHGCPRLTRLNISGCSSFSDTALIYLTCRCKNLKCLNLCGCVKAVTDRALQAIAQNCGQLQSLNLGWCDDVTDKGVTSLASGCPDLRAVDSCGCVLITDESVVALANGCPHLRSLGLYFCQNITDRAMYSLANSRVKSKRGRWDAVKDGLANLNISQCTALTPPAVQAVCDSFPALHTCPERHSLIISGCLSLTSVHCACALHPHRAGRALMANHAY

SEQ ID NO: 6379 - DNA, 1166 bp, Arabidopsis thaliana
  misc_feature (1)..(1166): useful for making plants with modified plant phenotypes as described in USSN 12/139,269
  misc_feature (1)..(1166): Ceres CLONE ID no. 19510
  misc_feature (1)..(1166): Also known as  Ceres CDNA ID no. 23377266
gtctcctctccaccaagtgaatctctttctctctctctttttctccgcggaaggaatctcttcttctggttgcgtttgagtccgtacgaaaacaaaagaaaagagagagatggcggaagagaagaaagctccaatcagtgtctggactaccgtgaagcccttcgtcaatggcggtgcctctggtatgctcgctacttgcgttatccagccgatcgacatgattaaggtgaggattcaacttggtcagggatctgcagcaagtataaccaccaacatgcttaagaatgagggcgttggtgccttctacaagggattatctgctgggttgctgaggcaagcaacttacacgacagcccgtcttggatcattcaagttgctgactgcaaaggcaattgagtctaatgatggaaagcctctaccgctgtatcagaaggcactatgtggtctgacagctggtgctattggtgcttgcgtcggtagtccagccgatctagcacttatcagaatgcaggccgataatactttgccgctagctcagcgcaggaattataccaatgctttccatgcgcttacccgtattagcgctgatgagggagttttagcactttggaaagggtgtgggcccactgtggtcagagctatggctttgaacatgggaatgcttgcatcttatgatcaaagtgctgaatacatgagagataatcttggtttcggggagatgtctacggtcgtaggagcaagtgctgtttctgggttctgcgctgcggcttgcagtctgccatttgactttgtcaaaactcagattcagaaaatgcaaccggatgctcaaggaaagtatccatacacaggttcgctcgattgtgcgatgaaaaccttaaaagaaggaggacctctgaaattttactcaggtttcccagtttactgtgtcaggattgcccctcacgtcatgatgacatggatcttcctaaaccagattacgaaatttcaaaagaagattggtatgtgaggaacgaagacagcagcaaaaaaataagatgagaagaacgaaaacacaattggaattgtgttcatttactttttaatcatatacataacctgccttaaaagcatattattgtagctgtttgaactttaattttttgtttcggtcggtgattggtccgggg

SEQ ID NO: 6380 - protein, 298 aa, Arabidopsis thaliana
  misc_feature (1)..(298): useful for making plants with modified plant phenotypes as described in USSN 12/139,269
  misc_feature (104)..(199): Pfam Name: Mito_carr; Pfam Description: Mitochondrial carrier protein
  misc_feature (1)..(298): Utility: Useful for increasing chlorophyll and photosynthetic capacity
  misc_feature (1)..(298): Utility: Useful for making ornamental plants with modified flowers
  misc_feature (1)..(298): Utility: Useful for making ornamental plants with modified leaves
  misc_feature (1)..(298): Utility: Useful for making plants with increased biomass and foliage
  misc_feature (1)..(298): Utility: Useful for making smaller plants
MAEEKKAPISVWTTVKPFVNGGASGMLATCVIQPIDMIKVRIQLGQGSAASITTNMLKNEGVGAFYKGLSAGLLRQATYTTARLGSFKLLTAKAIESNDGKPLPLYQKALCGLTAGAIGACVGSPADLALIRMQADNTLPLAQRRNYTNAFHALTRISADEGVLALWKGCGPTVVRAMALNMGMLASYDQSAEYMRDNLGFGEMSTVVGASAVSGFCAAACSLPFDFVKTQIQKMQPDAQGKYPYTGSLDCAMKTLKEGGPLKFYSGFPVYCVRIAPHVMMTWIFLNQITKFQKKIGM

SEQ ID NO: 6381 - protein, 347 aa, Glycine max
  misc_feature (1)..(347): useful for making plants with modified plant phenotypes as described in USSN 12/139,269
  misc_feature (1)..(347): Ceres CLONE ID no. 473358
  misc_feature (1)..(347): Utility: Useful for increasing chlorophyll and photosynthetic capacity
  misc_feature (1)..(347): Utility: Useful for making ornamental plants with modified flowers
  misc_feature (1)..(347): Utility: Useful for making ornamental plants with modified leaves
  misc_feature (1)..(347): Utility: Useful for making plants with increased biomass and foliage
  misc_feature (1)..(347): Utility: Useful for making smaller plants
LGFPHTYFQLLRARITVALLTRSPSFFSSSSSSLNPPFIFPISLTSMGDENKTKSPASGVWSTIKPFVNGGASGMLATCVIQPIDMIKVRIQLGQGSAAQVTSTMLKNEGVAAFYKGLSAGLLRQATYTTARLGSFKILTAKAIEANDGKPLPLYQKALCGLTAGAIGASVGSPADLALIRMQADATLPAAQRRNYTNAFHALYRITADEGVLALWKGAGPTVVRAMALNMGMLASYDQSVEFFRDSVGLGEGATVLGASSVSGFFAAACSLPFDYVKTQIQKMQPDADGKYPYTGSVDCAVKTFKAGGPFKFYTGFPVYCVRIAPHVMMTWIFLNQIQKLQKSYGL

SEQ ID NO: 6382 - protein, 297 aa, Glycine max
  misc_feature (1)..(297): useful for making plants with modified plant phenotypes as described in USSN 12/139,269
  misc_feature (1)..(297): Public GI no. 1486472
  misc_feature (1)..(297): Utility: Useful for increasing chlorophyll and photosynthetic capacity
  misc_feature (1)..(297): Utility: Useful for making ornamental plants with modified flowers
  misc_feature (1)..(297): Utility: Useful for making ornamental plants with modified leaves
  misc_feature (1)..(297): Utility: Useful for making plants with increased biomass and foliage
  misc_feature (1)..(297): Utility: Useful for making smaller plants
MGEKPVSGGVWPTVKPFINGGVSGMLATCVIQPIDMIKVRIQLGQGSAADVTKTMLKNEGFGAFYKGLSAGLLRQATYTTARLGSFRILTNKAIEANEGKPLPLYQKALCGLTAGAIGATVGSPADLALIRMQADATLPLAQRRNYTNAFHALSRIAVDEGVLALWKGAGPTVVRAMALNMGMLASYDQSVEFFRDNLGMGEAATVVGASSVSGFFAAACSLPFDYVKTQIQKMQPDAEGKLPYTGSFDCAMKTLKAGGPFKFYTGFPVYCIRIAPHVMMTWIFLNQIQKVEKKIGL

SEQ ID NO: 6383 - protein, 300 aa, Glycine max
  misc_feature (1)..(300): useful for making plants with modified plant phenotypes as described in USSN 12/139,269
  misc_feature (1)..(300): Public GI no. 19913109
  misc_feature (1)..(300): Utility: Useful for increasing chlorophyll and photosynthetic capacity
  misc_feature (1)..(300): Utility: Useful for making ornamental plants with modified flowers
  misc_feature (1)..(300): Utility: Useful for making ornamental plants with modified leaves
  misc_feature (1)..(300): Utility: Useful for making plants with increased biomass and foliage
  misc_feature (1)..(300): Utility: Useful for making smaller plants
MGDKAKSTSSAGAWPTVKPFANGGASGMLATCVIQPIDMIKVRIQLGQGSAGEVTRTMLKNEGFGAFYKGLSAGLLRQATYTTARLGSFRVLTNKAIEANDGKPLPLYQKALCGLTAGAIGACFGSPADLALIRMQADATLPVAQRRNYTNAFHALYRIVADEGVLSLWKGAGPTVVRAMALNMGMLASYDQSVEFFKDNLGMGEAATVVGASSVSGFFAAACSLPFDYVKTQIQKMQPDAQGKYPYTGSFDCAMKTLKSGGPFKFYTGFPVYCVRIAPHVMMTWIFLNQIQKVEKKIGL

SEQ ID NO: 6384 - protein, 297 aa, Glycine max
  misc_feature (1)..(297): useful for making plants with modified plant phenotypes as described in USSN 12/139,269
  misc_feature (1)..(297): Public GI no. 19913105
  misc_feature (1)..(297): Utility: Useful for increasing chlorophyll and photosynthetic capacity
  misc_feature (1)..(297): Utility: Useful for making ornamental plants with modified flowers
  misc_feature (1)..(297): Utility: Useful for making ornamental plants with modified leaves
  misc_feature (1)..(297): Utility: Useful for making plants with increased biomass and foliage
  misc_feature (1)..(297): Utility: Useful for making smaller plants
MGEKPKSGGVWPTVKPFVNGGASGMLATCVIQPIDMIKVRIQLGQGSAVDVTKTMLKNEGFGAFYKGLSAGLLRQATYTTARLGSFRSLTNKAIEANEGKPLPLYQKALCGLTAGAIGACVGSPADLALIRMQADATLPLAQRRHYTNAFHALSRIVADEGVLALWKGAGPTVVRAMALNMGMLASYDQSVEFCRDNLGMSEAATVVGASSVSGFFAAACSLPFDYVKTQIQKMQPDAEGKLPYSGSFDCAMKTLKAGGPFKFYTGFPVYCVRIAPHVMMTWIFLNQIQKAEKKLGL

SEQ ID NO: 6385 - protein, 295 aa, Glycine max
  misc_feature (1)..(295): useful for making plants with modified plant phenotypes as described in USSN 12/139,269
  misc_feature (1)..(295): Public GI no. 19913107
  misc_feature (1)..(295): Utility: Useful for increasing chlorophyll and photosynthetic capacity
  misc_feature (1)..(295): Utility: Useful for making ornamental plants with modified flowers
  misc_feature (1)..(295): Utility: Useful for making ornamental plants with modified leaves
  misc_feature (1)..(295): Utility: Useful for making plants with increased biomass and foliage
  misc_feature (1)..(295): Utility: Useful for making smaller plants
EKPKSGGVWPTVKPFVNGGASGMLATCVIQPIDMIKVRIQLGQGSAVDVTKTMLKNEGFGAFYKGLSAGLLRQATYTTARLGSFRILTNKAIEANEGKPLPLYQKALCGLTAGAIGACFGSPADLALIRMQADATLPLAQRRHYTNAFHALSRIVADEGVLALWKGAGPTVVRAMALNMGMLASYDQSVEFCRDNLGMSEAATVVGASSVSGFFAAACSLPFDYVKTQIQKMQPDAEGKLPYSGSFDCAMKTLKAGGPFKFYTGFPVYCVRIAPHVMMTWIFLNQIQKAEKKLGL

SEQ ID NO: 6386 - protein, 306 aa, Glycine max
  misc_feature (1)..(306): useful for making plants with modified plant phenotypes as described in USSN 12/139,269
  misc_feature (1)..(306): Public GI no. 53749331
  misc_feature (1)..(306): Utility: Useful for increasing chlorophyll and photosynthetic capacity
  misc_feature (1)..(306): Utility: Useful for making ornamental plants with modified flowers
  misc_feature (1)..(306): Utility: Useful for making ornamental plants with modified leaves
  misc_feature (1)..(306): Utility: Useful for making plants with increased biomass and foliage
  misc_feature (1)..(306): Utility: Useful for making smaller plants
MADAKQQQQQQTAAAATGVWKTVKPFVNGGASGMLATCVIQPIDMVKVKIQLGEGSAAQVTKNMLANEGIGSFYKGLSAGLLRQATYTTARLGSFRVLTNKAIEKNDGKPLPLVQKAFIGLTAGAIGACVGSPADLALIRMQADSTLPIAQRRNYKNAFHALYRIIADEGVLALWKGAGPTVVRAMALNMGMLASYDQSVELFRDKLGAGEVSTVLGASAVSGFFASACSLPFDYVKTQIQKMQPDASGKYPYTGSLDCAMKTFKSGGPFKFYTGFPVYCVRIAPHVMMTWIFLNQIQKFEKQIGI

SEQ ID NO: 6387 - protein, 297 aa, Glycine max
  misc_feature (1)..(297): useful for making plants with modified plant phenotypes as described in USSN 12/139,269
  misc_feature (1)..(297): Public GI no. 10798640
  misc_feature (1)..(297): Utility: Useful for increasing chlorophyll and photosynthetic capacity
  misc_feature (1)..(297): Utility: Useful for making ornamental plants with modified flowers
  misc_feature (1)..(297): Utility: Useful for making ornamental plants with modified leaves
  misc_feature (1)..(297): Utility: Useful for making plants with increased biomass and foliage
  misc_feature (1)..(297): Utility: Useful for making smaller plants
MVEKPKSGGVWPTVKPFVNGGASGMLATCVIQPIDMIKVRIQLGQGSAVDVTKTMLKNEGFGAFYKGLSAGLLRQATYTTARLGSFRILTNKAIEANEGKPLPLYQKALCGLTAGAIGACFGSPADLALIRMQADATLPLAQRRHYTNAFHALSRIVADEGVLALWKGAGPTVVRAMALNMGMLASYDQSVEFCRDNLGMSEAATVVGASSVSGFFAAACSLPFDYVKTQIQKMQPDAEGKLPYSGSFDCAMKTLKAGGPFKFYTGFPVYCVRIAPHVMMTWIFLNQIQKAEKKLGL

SEQ ID NO: 6388 - protein, 363 aa, Zea mays
  misc_feature (1)..(363): useful for making plants with modified plant phenotypes as described in USSN 12/139,269
  misc_feature (1)..(363): Ceres CLONE ID no. 234671
  misc_feature (1)..(363): Utility: Useful for increasing chlorophyll and photosynthetic capacity
  misc_feature (1)..(363): Utility: Useful for making ornamental plants with modified flowers
  misc_feature (1)..(363): Utility: Useful for making ornamental plants with modified leaves
  misc_feature (1)..(363): Utility: Useful for making plants with increased biomass and foliage
  misc_feature (1)..(363): Utility: Useful for making smaller plants
QPFLLPFSISRYVPTQRSRPPPLLLHLPRSRRLVRFASAPPRPEQSAALSGAGMADAKQQQQQQQPQQAAAAATGVWKTVKPFVNGGASGMLATCVIQPIDMVKVRIQLGEGSAGQVTRNMLANEGVRSFYKGLSAGLLRQATYTTARLGSFRVLTNKAVEKNEGKPLPLFQKAFIGLTAGAIGACVGSPADLALIRMQADSTLPVAQRRNYKNAFHALYRISGDEGVLALWKGAGPTVVRAMALNMGMLASYDQSVELFRDKFGAGEISTVVGASAVSGFFASACSLPFDYVKTQIQKMQPDANGKYPYTGSLDCAVKTFKSGGPFKFYTGFPVYCVRIAPHVMMTWIFLNQIQKFEKKIGI

SEQ ID NO: 6389 - protein, 308 aa, Zea mays
  misc_feature (1)..(308): useful for making plants with modified plant phenotypes as described in USSN 12/139,269
  misc_feature (1)..(308): Ceres CLONE ID no. 1396898
  misc_feature (1)..(308): Utility: Useful for increasing chlorophyll and photosynthetic capacity
  misc_feature (1)..(308): Utility: Useful for making ornamental plants with modified flowers
  misc_feature (1)..(308): Utility: Useful for making ornamental plants with modified leaves
  misc_feature (1)..(308): Utility: Useful for making plants with increased biomass and foliage
  misc_feature (1)..(308): Utility: Useful for making smaller plants
MADAKQQQQQPQQAAAAATGVWKTVKPFVNGGASGMLATCVIQPIDMVKVRIQLGEGSAGQVTRNMLANEGVRSFYKGLSAGLLRQATYTTARLGSFRVLTNKAVEKNEGKPLPLIQKAFIGLTAGAIGACFGSPADLALIRMQADSTLPAAQRRNYKNAFHALYRISADEGVLALWKGAGPTVVRAMALNMGMLASYDQSVELFRDKFGAGEISTVVGASAVSGFFASACSLPFDYVKTQIQKMQPDANGKYPYTGSLDCAVKTFKSGGPFKFYTGFPVYCVRIAPHVMMTWIFLNQIQKFEKKIGI

SEQ ID NO: 6390 - protein, 299 aa, Zea mays
  misc_feature (1)..(299): useful for making plants with modified plant phenotypes as described in USSN 12/139,269
  misc_feature (1)..(299): Public GI no. 37964368
  misc_feature (1)..(299): Utility: Useful for increasing chlorophyll and photosynthetic capacity
  misc_feature (1)..(299): Utility: Useful for making ornamental plants with modified flowers
  misc_feature (1)..(299): Utility: Useful for making ornamental plants with modified leaves
  misc_feature (1)..(299): Utility: Useful for making plants with increased biomass and foliage
  misc_feature (1)..(299): Utility: Useful for making smaller plants
MGEEKKPQSAGVWPTVKPFVNGGASGMLATCVIQPIDMIKVRIQLGQGSAGTVTKTMLKNEGFGAFYKGLSAGLLRQATYTTARLGSFRILTNKAIEANDGKPLPLYQKALCGLTAGAIGASVGSPADLALIRMQADATLPAAQRRHYTNAFQALYRIVTDEGVLALWKGAGPTVVRAMALNMGMLASYDQSVEFFRDACGLSELPTVIGASTVSGFFASACSLPFDYVKTQIQKMQPDAQGKYPYTGSMDCAMKTLKAGGPFKFYTGFPVYCVRIAPHVMMTWIFLNQIQKLEKKVGL

SEQ ID NO: 6391 - protein, 307 aa, Zea mays
  misc_feature (1)..(307): useful for making plants with modified plant phenotypes as described in USSN 12/139,269
  misc_feature (1)..(307): Public GI no. 51860703
  misc_feature (1)..(307): Utility: Useful for increasing chlorophyll and photosynthetic capacity
  misc_feature (1)..(307): Utility: Useful for making ornamental plants with modified flowers
  misc_feature (1)..(307): Utility: Useful for making ornamental plants with modified leaves
  misc_feature (1)..(307): Utility: Useful for making plants with increased biomass and foliage
  misc_feature (1)..(307): Utility: Useful for making smaller plants
MADAKQQPQQAAAAAATTGVWKTVKPFVNGGASGMLATCVIQPIDMVKVRIQLGEGSAGQVTRNMLANEGVRSFYKGLSAGLLRQATYTTARLGSFRVLTNKAVEKNEGKPLPLIQKAFIGLTAGAIGACVGSPADLALIRMQADSTLPAAQRRNYKNAFHALYRITADEGVLALWKGAGPTVVRAMALNMGMLASYDQSVELFRDKLGAGEISTVVGASAISGFFASACSLPFDYVKTQIQKMQPDANGKYPYTGSLDCAVKTFKSGGPFKFYTGFPVYCVRIAPHVMMTWIFLNQIQKIEKKIGI

SEQ ID NO: 6392 - protein, 302 aa, Triticum aestivum
  misc_feature (1)..(302): useful for making plants with modified plant phenotypes as described in USSN 12/139,269
  misc_feature (1)..(302): Ceres CLONE ID no. 702388
  misc_feature (1)..(302): Utility: Useful for increasing chlorophyll and photosynthetic capacity
  misc_feature (1)..(302): Utility: Useful for making ornamental plants with modified flowers
  misc_feature (1)..(302): Utility: Useful for making ornamental plants with modified leaves
  misc_feature (1)..(302): Utility: Useful for making plants with increased biomass and foliage
  misc_feature (1)..(302): Utility: Useful for making smaller plants
MADAKQQQAAAPTGVWKTIKPFVNGGASGMLATCVIQPIDMIKVKIQLGEGSAAQVAKTMYANEGLGSFYKGLSAGLLRQATYTTARLGSFRVLTNKAIEANDGKPLPLVQKAFIGLTAGAIGACVGSPADLALIRMQADSTLPAAQRRHYKNAFHALYRITADEGVLALWKGAGPTVVRAMSLNMGMLASYDQSVELFRDKLGAGEYQTVIGASAISGFCAAACSLPFDYVKTQIQKMQPDATGKYPYTGSLDCAMQTLKTGGPFKFYSGFPVYCVRIAPHVMMTWLFLNQIQKYQKKIGI

SEQ ID NO: 6393 - protein, 302 aa, Triticum aestivum; identical to SEQ ID NO: 6392
  misc_feature (1)..(302): useful for making plants with modified plant phenotypes as described in USSN 12/139,269
  misc_feature (1)..(302): Ceres CLONE ID no. 1319106
  misc_feature (1)..(302): Utility: Useful for increasing chlorophyll and photosynthetic capacity
  misc_feature (1)..(302): Utility: Useful for making ornamental plants with modified flowers
  misc_feature (1)..(302): Utility: Useful for making ornamental plants with modified leaves
  misc_feature (1)..(302): Utility: Useful for making plants with increased biomass and foliage
  misc_feature (1)..(302): Utility: Useful for making smaller plants

SEQ ID NO: 6394 - protein, 309 aa, Oryza sativa
  misc_feature (1)..(309): useful for making plants with modified plant phenotypes as described in USSN 12/139,269
  misc_feature (1)..(309): Public GI no. 62701911
  misc_feature (1)..(309): Utility: Useful for increasing chlorophyll and photosynthetic capacity
  misc_feature (1)..(309): Utility: Useful for making ornamental plants with modified flowers
  misc_feature (1)..(309): Utility: Useful for making ornamental plants with modified leaves
  misc_feature (1)..(309): Utility: Useful for making plants with increased biomass and foliage
  misc_feature (1)..(309): Utility: Useful for making smaller plants
MAEAKQQQQQPQAATAAAASGVWKTVKPFANGGASGMLATCVIQPIDMVKVRIQLGEGSAASVTKKMLANEGISAFYKGLSAGLLRQATYTTARLGSFRVLTNKAVEANDGKPLPLVQKAGIGLTAGAIGACVGSPADLALIRMQADSTLPAAQSRNYKNAFHALYRIAADEGVLALWKGAGPTVVRAMSLNMGMLASYDQSVELFRDTLGAGEVTTVLGASAVSGLCASACSLPFDYVKTQIQKMQPDASGKYPYTGSLDCAMKTLKSGGPFKFYTGFPVYCVRIAPHAMMTWIFLNEIQKLEKRLGL

SEQ ID NO: 6395 - protein, 313 aa, Mesembryanthemum crystallinum
  misc_feature (1)..(313): useful for making plants with modified plant phenotypes as described in USSN 12/139,269
  misc_feature (1)..(313): Public GI no. 61651612
  misc_feature (1)..(313): Utility: Useful for increasing chlorophyll and photosynthetic capacity
  misc_feature (1)..(313): Utility: Useful for making ornamental plants with modified flowers
  misc_feature (1)..(313): Utility: Useful for making ornamental plants with modified leaves
  misc_feature (1)..(313): Utility: Useful for making plants with increased biomass and foliage
  misc_feature (1)..(313): Utility: Useful for making smaller plants
MGEEEKGKSASNSSSNSNSNSNSSGVWRTIKPFVNGGASGMLATCVIQPIDMVKVRIQLGQGSALSITKNMLRDDGIRAFYKGLSAGLLRQATYTTARLGSFKILTNKALEANEGKPLPLYQKALCGLSAGAIGASVGSPADLALIRMQADATLPEAQRRHYKNAFHALYRIIADEGVLALWKGAAPTVVRAMALNMGMLASYDQSVEFFRDSLGYGEVATVLGASTVSGFFASACSLPFDYVKTQIQKMQPDAEGKYPYKGSLDCTIKTLKSGGPFKFYTGFPVYCVRIAPHAMMTLIFLHQIQKLESTIGV

SEQ ID NO: 6396 - protein, 302 aa, Panicum miliaceum
  misc_feature (1)..(302): useful for making plants with modified plant phenotypes as described in USSN 12/139,269
  misc_feature (1)..(302): Public GI no. 1100743
  misc_feature (1)..(302): Public GI no. 2130089
  misc_feature (1)..(302): Utility: Useful for increasing chlorophyll and photosynthetic capacity
  misc_feature (1)..(302): Utility: Useful for making ornamental plants with modified flowers
  misc_feature (1)..(302): Utility: Useful for making ornamental plants with modified leaves
  misc_feature (1)..(302): Utility: Useful for making plants with increased biomass and foliage
  misc_feature (1)..(302): Utility: Useful for making smaller plants
MADAKQQQAVAPSAAWMTVKPFVNGGASGMLATCVIQPIDMVKVKIQLGEGSAATVTKKMLANEGIGSFYKGLSAGLLRQATYTTARLGSFRVLTNKAVEANEGKPLPLLQKAVIGLTAGAIGASVGSPADLALIRMQADSTLPAAQRRNYKNAFHALYRIVADEGVLALWKGAGPTVVRAMSLNMGMLASYDQSVELFRDTLGAGELSTMLGASAVSGFCASACSLPFDYVKTQIQKMQPDANGKYPYTGSLDCVMKTLKSGGPFKFYTGFPVYCVRIAPHVMLTWIFLNQIQKFEKDIGL

SEQ ID NO: 6397 - protein, 302 aa, Panicum miliaceum
  misc_feature (1)..(302): useful for making plants with modified plant phenotypes as described in USSN 12/139,269
  misc_feature (1)..(302): Public GI no. 1100741
  misc_feature (1)..(302): Public GI no. 2130090
  misc_feature (1)..(302): Utility: Useful for increasing chlorophyll and photosynthetic capacity
  misc_feature (1)..(302): Utility: Useful for making ornamental plants with modified flowers
  misc_feature (1)..(302): Utility: Useful for making ornamental plants with modified leaves
  misc_feature (1)..(302): Utility: Useful for making plants with increased biomass and foliage
  misc_feature (1)..(302): Utility: Useful for making smaller plants
MADAKQQQAVAPSAAWMMVKPFVNGGASGMLATCVIQPIDMVKVKIQLGEGSAATVTKKMLANEGIGSFYKGLSAGLLRQATYTTARLGSFRVLTNKAVEANEGKPLPLLQKAVIGLTAGAIGASVGSPADLALIRMQADSTLPAAQRRNYKNAFHALYRIVADEGVLALWKGAGPTVVRAMSLNMGMLASYDQSVELFRDKLGAGELSTMLGASAVSGFCASACSLPFDYVKTQIQKMQPDANGKYPYTGSLDCVMKTLKSGGPFKFYTGFPVYCVRIGPHVMLTWIFLNQIQKFEKDMGL

SEQ ID NO: 6398 - DNA, 692 bp, Arabidopsis thaliana
  misc_feature (1)..(692): useful for making plants with modified plant phenotypes as described in USSN 12/139,269
  misc_feature (1)..(692): Ceres CLONE ID no. 23322
  misc_feature (1)..(692): Also known as  Ceres CDNA ID no. 23358139
gatcacaaattcagaagaaaagaacagagaaaacagaggaagaggtgagatggaggaacttgtagggcttctgagaatccgagtgaagagagggatcaatcttgctcagcgagacactctaagcagcgacccttttgttgtcataaccatgggatcacagaagctgaagactcgtgttgtggaaaataactgcaaccctgagtggaacgaggaattaacccttgcgttaagacatcccgatgaacctgtgaatctgatagtgtatgataaagatacattcacatcgcacgacaagatgggagatgcaaagatagatattaaaccatttctggaggttcacaaaatgggtttgcaagaacttccagatggaacagagatcaagagagttgtgcccaacagagaaaactgtttggctgaagcgagcagtatcgtctccaataatggcaaaatcgttcagaacatgattcttctgttgaggaatgtcgaatgcggtgaggtcgagattcagcttgaatggattgatattccaggttctagagggctttgaacatatctctttctgtgtgtaataaaaaaaaaactcagttcgttttgggtttttagacaaaagtcacaataagtagaacagagtactactctgttttgtaattgaaatatttggttttagcacctaacctaaatcgttttggttt

SEQ ID NO: 6399 - protein, 165 aa, Arabidopsis thaliana
  misc_feature (1)..(165): useful for making plants with modified plant phenotypes as described in USSN 12/139,269
  misc_feature (8)..(87): Pfam Name: C2; Pfam Description: C2 domain
  misc_feature (1)..(165): Utility: Useful for increasing chlorophyll and photosynthetic capacity
  misc_feature (1)..(165): Utility: Useful for increasing seed/fruit yield or modifying fruit content
  misc_feature (1)..(165): Utility: Useful for making ornamental plants with modified flowers
  misc_feature (1)..(165): Utility: Useful for making smaller plants
  misc_feature (1)..(165): Utility: Useful for making stronger plants
  misc_feature (1)..(165): Utility: Useful for making taller plants and plants with longer inflorescences
MEELVGLLRIRVKRGINLAQRDTLSSDPFVVITMGSQKLKTRVVENNCNPEWNEELTLALRHPDEPVNLIVYDKDTFTSHDKMGDAKIDIKPFLEVHKMGLQELPDGTEIKRVVPNRENCLAEASSIVSNNGKIVQNMILLLRNVECGEVEIQLEWIDIPGSRGL

SEQ ID NO: 6400 - protein, 191 aa, Brassica napus
  misc_feature (1)..(191): useful for making plants with modified plant phenotypes as described in USSN 12/139,269
  misc_feature (1)..(191): Ceres CLONE ID no. 950968
  misc_feature (1)..(191): Utility: Useful for increasing chlorophyll and photosynthetic capacity
  misc_feature (1)..(191): Utility: Useful for increasing seed/fruit yield or modifying fruit content
  misc_feature (1)..(191): Utility: Useful for making ornamental plants with modified flowers
  misc_feature (1)..(191): Utility: Useful for making smaller plants
  misc_feature (1)..(191): Utility: Useful for making stronger plants
  misc_feature (1)..(191): Utility: Useful for making taller plants and plants with longer inflorescences
DIDRCLFSQEKTQRNFVWREQRKRLKMEELAGLLRIRVKKGINLARRDSLSSDPFVVITMGTQKLKGRTVENNCNPEWNEELTLALKHPNEPVTLIVYDKDTFTSHDKMGDAKIDIKPFLEVHKLGLQELPDGTVIKRVLPTKENCLSEESRIVYHNGKIVQDMILVLRNVECGEVEIQLEWIEIPGGRGL

SEQ ID NO: 6401 - protein, 165 aa, Glycine max
  misc_feature (1)..(165): useful for making plants with modified plant phenotypes as described in USSN 12/139,269
  misc_feature (1)..(165): Ceres CLONE ID no. 513057
  misc_feature (1)..(165): Utility: Useful for increasing chlorophyll and photosynthetic capacity
  misc_feature (1)..(165): Utility: Useful for increasing seed/fruit yield or modifying fruit content
  misc_feature (1)..(165): Utility: Useful for making ornamental plants with modified flowers
  misc_feature (1)..(165): Utility: Useful for making smaller plants
  misc_feature (1)..(165): Utility: Useful for making stronger plants
  misc_feature (1)..(165): Utility: Useful for making taller plants and plants with longer inflorescences
MENLLGLLRIHVEKGVNLAIRDVVSSDPYVVIKMGKQKLKTRVVNKNLNPEWNDDLTLSISDPHAPIHLHVYDKDTFSMDDKMGDAEFFIGPFIEAVKMRLSSLPNNTIVTKVLPSRQNSLAEESHIVWKDGKVVQNMVLRLRNVETGEVELQLHWIDIPGSRHL

SEQ ID NO: 6402 - protein, 207 aa, Triticum aestivum
  misc_feature (1)..(207): useful for making plants with modified plant phenotypes as described in USSN 12/139,269
  misc_feature (1)..(207): Ceres CLONE ID no. 568719
  misc_feature (1)..(207): Utility: Useful for increasing chlorophyll and photosynthetic capacity
  misc_feature (1)..(207): Utility: Useful for increasing seed/fruit yield or modifying fruit content
  misc_feature (1)..(207): Utility: Useful for making ornamental plants with modified flowers
  misc_feature (1)..(207): Utility: Useful for making smaller plants
  misc_feature (1)..(207): Utility: Useful for making stronger plants
  misc_feature (1)..(207): Utility: Useful for making taller plants and plants with longer inflorescences
EKGTAAVPCLQPQLNQSVAITLVSHHPPRARSRRSSTMLGHLVGLVKVRVTRGVNLAIRDLRSSDPYVVVRMGKQKLKTRVVRKSINPEWNDELTLSIEDPTIPVKLDVFDKDTFFDDPMGNAELDIGPLVEAARMRVQLQGVADNTVVKKLVPNRQNCLAEQSAIYLSEGTVKQDVVLRLRNVECGEVELQLQWIDIPGSKGVSGF

SEQ ID NO: 6403 - protein, 165 aa, Triticum aestivum
  misc_feature (1)..(165): useful for making plants with modified plant phenotypes as described in USSN 12/139,269
  misc_feature (1)..(165): Public GI no. 50907613
  misc_feature (1)..(165): Utility: Useful for increasing chlorophyll and photosynthetic capacity
  misc_feature (1)..(165): Utility: Useful for increasing seed/fruit yield or modifying fruit content
  misc_feature (1)..(165): Utility: Useful for making ornamental plants with modified flowers
  misc_feature (1)..(165): Utility: Useful for making smaller plants
  misc_feature (1)..(165): Utility: Useful for making stronger plants
  misc_feature (1)..(165): Utility: Useful for making taller plants and plants with longer inflorescences
MLGHLVGLVKVRVVRGVNLAVRDLRSSDPYVIVRMGKQKLKTRVIKKTTNPEWNDELTLSIEDPAVPVRLEVYDKDTFIDDAMGNAELDIRPLVEVVKMKIEGVADNTVVKKVVPNRQNCLAEESTIYISEGKVKQDVVLRLRDVECGEIELQLQWVDIPGSKGV

SEQ ID NO: 6404 - protein, 165 aa, Zea mays
  misc_feature (1)..(165): useful for making plants with modified plant phenotypes as described in USSN 12/139,269
  misc_feature (1)..(165): Ceres CLONE ID no. 302545
  misc_feature (1)..(165): Utility: Useful for increasing chlorophyll and photosynthetic capacity
  misc_feature (1)..(165): Utility: Useful for increasing seed/fruit yield or modifying fruit content
  misc_feature (1)..(165): Utility: Useful for making ornamental plants with modified flowers
  misc_feature (1)..(165): Utility: Useful for making smaller plants
  misc_feature (1)..(165): Utility: Useful for making stronger plants
  misc_feature (1)..(165): Utility: Useful for making taller plants and plants with longer inflorescences
MLDHLVGLLKLRVVRGVNLAVRDLRSSDPYVVVRIGKQKLKTRVVKKSVNPEWDDELTLSIEDPAVPIRLEVFDKDTFVDDTMGNAEVDIRPLVEIVKMKLQDVADRTVVKKLVPNRQNCLAEESSIYISEGKVKQDMVVRLRNVESGEIELQLQWIDLPGSKGV

SEQ ID NO: 6405 - protein, 165 aa, Zea mays; identical to SEQ ID NO: 6404
  misc_feature (1)..(165): useful for making plants with modified plant phenotypes as described in USSN 12/139,269
  misc_feature (1)..(165): Ceres CLONE ID no. 242695
  misc_feature (1)..(165): Utility: Useful for increasing chlorophyll and photosynthetic capacity
  misc_feature (1)..(165): Utility: Useful for increasing seed/fruit yield or modifying fruit content
  misc_feature (1)..(165): Utility: Useful for making ornamental plants with modified flowers
  misc_feature (1)..(165): Utility: Useful for making smaller plants
  misc_feature (1)..(165): Utility: Useful for making stronger plants
  misc_feature (1)..(165): Utility: Useful for making taller plants and plants with longer inflorescences

SEQ ID NO: 6406 - protein, 176 aa, Zea mays
  misc_feature (1)..(176): useful for making plants with modified plant phenotypes as described in USSN 12/139,269
  misc_feature (1)..(176): Ceres CLONE ID no. 399010
  misc_feature (1)..(176): Utility: Useful for increasing chlorophyll and photosynthetic capacity
  misc_feature (1)..(176): Utility: Useful for increasing seed/fruit yield or modifying fruit content
  misc_feature (1)..(176): Utility: Useful for making ornamental plants with modified flowers
  misc_feature (1)..(176): Utility: Useful for making smaller plants
  misc_feature (1)..(176): Utility: Useful for making stronger plants
  misc_feature (1)..(176): Utility: Useful for making taller plants and plants with longer inflorescences
MVGKKRGVISPLDHLAGLLEVRVVRGVDLAIRDLRSSDPYVVLRIGKAQKVKTRVVKKSINPEWNEKLTLSIEDPAVPIRLEVFDKDTFVDDAMGNAELDIRPLVEIVKMKLQGVADKTVVKKLVPNRQNCLAEESSIYISEGKVKQDLVVRLRNVECGEIELQLQWVHLPGSKGV

SEQ ID NO: 6407 - protein, 168 aa, Parthenium argentatum
  misc_feature (1)..(168): useful for making plants with modified plant phenotypes as described in USSN 12/139,269
  misc_feature (1)..(168): Ceres CLONE ID no. 1605876
  misc_feature (1)..(168): Utility: Useful for increasing chlorophyll and photosynthetic capacity
  misc_feature (1)..(168): Utility: Useful for increasing seed/fruit yield or modifying fruit content
  misc_feature (1)..(168): Utility: Useful for making ornamental plants with modified flowers
  misc_feature (1)..(168): Utility: Useful for making smaller plants
  misc_feature (1)..(168): Utility: Useful for making stronger plants
  misc_feature (1)..(168): Utility: Useful for making taller plants and plants with longer inflorescences
MEGVVGLWKLRVKRGINLVARDTKSSDAYIVATLDDQKTKAKVTKGSCNPVWNDELTLTMRDPKAPIHIAVYDKDRFSNDDNMGEAEIDVKPYIECLRMGLNMADTPNGTTLSCVQPTEHNCLANESSIIWENGKIVQDMHLRLRGVERGEVVIQIELVLLPGHNLDV

SEQ ID NO: 6408 - protein, 171 aa, Parthenium argentatum
  misc_feature (1)..(171): useful for making plants with modified plant phenotypes as described in USSN 12/139,269
  misc_feature (1)..(171): Public GI no. 1808694
  misc_feature (1)..(171): Utility: Useful for increasing chlorophyll and photosynthetic capacity
  misc_feature (1)..(171): Utility: Useful for increasing seed/fruit yield or modifying fruit content
  misc_feature (1)..(171): Utility: Useful for making ornamental plants with modified flowers
  misc_feature (1)..(171): Utility: Useful for making smaller plants
  misc_feature (1)..(171): Utility: Useful for making stronger plants
  misc_feature (1)..(171): Utility: Useful for making taller plants and plants with longer inflorescences
MASASKEEVIGKLNVRVVRGSNLAICDPLTHTSDPYVVLHYGAQKVKTSVQKKNPNPVWNEVLQLSVTNPTKPVHLEVFDEDKFTADDSMGVAEINLTDIYDAAKLDLKHAADGTRIKTIYPVGVNYLGGESHVMWKDGKVVQDLILKLTKTDSGLITLQLEWVHVPGVKL

SEQ ID NO: 6409 - DNA, 1062 bp, Arabidopsis thaliana
  misc_feature (1)..(1062): useful for making plants with modified plant phenotypes as described in USSN 12/139,269
  misc_feature (1)..(1062): Ceres CLONE ID no. 25538
  misc_feature (1)..(1062): Also known as  Ceres CDNA ID no. 23368230
agaacaattagggttaatctcttccgttgcttttttttttcaatccgccgccacttttcgtttctcgtagcgttaaaatggcggtatcgtacaatgcattagctcagtctttagcgagaagtagctgcttcatccccaaaccttattcctttagagatactaagctgagaagcagatccaatgtcgtattcgcgtgcaatgataataagaacattgctcttcaagctaaggtagataacttgttggaccgcattaaatgggatgacaaaggattagctgtggcaatagcacaaaacgttgatacgggagcagtattgatgcaaggctttgttaatagggaggccctctccacaaccatcagttctcggaaagctacattctttagtcgatcaagatctaccttatggactaagggagagacatccaataacttcatcaatattcttgatgtgtatgttgattgtgatcgtgattcgattatttaccttggaacacctgatggacctacctgtcacacaggggaagagacttgttactacacatcggtttttgatcaattaaacaatgatgaggcttcaggaaacaagctagcattaacaacattgtactcgctagaatcaatcatttccaagcggaaagaagaatcaacagttcctcaagaaggtaaaccatcatggactcgacggttgttgacggatgacgctctgctttgctcaaagatcagggaagaagctgacgagttatgcagaacactggaggataatgaggaagtttcaagaacaccatcagagatggctgatgttttataccacgcaatggtgcttctatctaaaaggggtgtgaagatggaagatgttcttgaagttcttaggaaacgcttctctcaatctggaatcgaggagaagcaaaaccgtacaaagtaaccattttcttcgattgtctgtttagtatttgcgagaatttttttagttactcggaacttatactgttgttcattgtgcaactttgtattgtataaatagatatcctttgtgataaaagaaataaatgagtcctttttcc

SEQ ID NO: 6410 - protein, 281 aa, Arabidopsis thaliana
  misc_feature (1)..(281): useful for making plants with modified plant phenotypes as described in USSN 12/139,269
  misc_feature (176)..(269): Pfam Name: PRA-PH; Pfam Description: Phosphoribosyl-ATP pyrophosphohydrolase
  misc_feature (81)..(155): Pfam Name: PRA-CH; Pfam Description: Phosphoribosyl-AMP cyclohydrolase
  misc_feature (1)..(281): Utility: Useful for increasing chlorophyll and photosynthetic capacity
  misc_feature (1)..(281): Utility: Useful for making lethal plants for genetic confinement systems
  misc_feature (1)..(281): Utility: Useful for making ornamental plants with modified flowers
  misc_feature (1)..(281): Utility: Useful for making ornamental plants with modified leaves
  misc_feature (1)..(281): Utility: Useful for making plants with altered leaf shape eg curled leaves
  misc_feature (1)..(281): Utility: Useful for making plants with increased biomass
  misc_feature (1)..(281): Utility: Useful for making smaller plants
MAVSYNALAQSLARSSCFIPKPYSFRDTKLRSRSNVVFACNDNKNIALQAKVDNLLDRIKWDDKGLAVAIAQNVDTGAVLMQGFVNREALSTTISSRKATFFSRSRSTLWTKGETSNNFINILDVYVDCDRDSIIYLGTPDGPTCHTGEETCYYTSVFDQLNNDEASGNKLALTTLYSLESIISKRKEESTVPQEGKPSWTRRLLTDDALLCSKIREEADELCRTLEDNEEVSRTPSEMADVLYHAMVLLSKRGVKMEDVLEVLRKRFSQSGIEEKQNRTK

SEQ ID NO: 6411 - protein, 179 aa, Arabidopsis thaliana
  misc_feature (1)..(179): useful for making plants with modified plant phenotypes as described in USSN 12/139,269
  misc_feature (1)..(179): Public GI no. 50313439
  misc_feature (1)..(179): Utility: Useful for increasing chlorophyll and photosynthetic capacity
  misc_feature (1)..(179): Utility: Useful for making lethal plants for genetic confinement systems
  misc_feature (1)..(179): Utility: Useful for making ornamental plants with modified flowers
  misc_feature (1)..(179): Utility: Useful for making ornamental plants with modified leaves
  misc_feature (1)..(179): Utility: Useful for making plants with altered leaf shape eg curled leaves
  misc_feature (1)..(179): Utility: Useful for making plants with increased biomass
  misc_feature (1)..(179): Utility: Useful for making smaller plants
GFVNREALATTISSRKATFFSRSRSSLWIKGETSNNFINILDVYIDCDRDSIIYLGTPDGPTCHTGAETCYYTSVFDQLNDEEPIGNKLALTTLYSLESIISKRKEESTVPQEGKPSWTRRLLTDDTLLCSKIREEADELCRTLEDNEEVSNTASEMADVLYHSMVLLSKRDVEIEDVL

SEQ ID NO: 6412 - protein, 279 aa, Brassica napus
  misc_feature (1)..(279): useful for making plants with modified plant phenotypes as described in USSN 12/139,269
  misc_feature (1)..(279): Ceres CLONE ID no. 947207
  misc_feature (1)..(279): Utility: Useful for increasing chlorophyll and photosynthetic capacity
  misc_feature (1)..(279): Utility: Useful for making lethal plants for genetic confinement systems
  misc_feature (1)..(279): Utility: Useful for making ornamental plants with modified flowers
  misc_feature (1)..(279): Utility: Useful for making ornamental plants with modified leaves
  misc_feature (1)..(279): Utility: Useful for making plants with altered leaf shape eg curled leaves
  misc_feature (1)..(279): Utility: Useful for making plants with increased biomass
  misc_feature (1)..(279): Utility: Useful for making smaller plants
  misc_feature (127)..(127): Xaa is any aa, unknown or other
  misc_feature (129)..(129): Xaa is any aa, unknown or other
  misc_feature (160)..(160): Xaa is any aa, unknown or other
  misc_feature (165)..(165): Xaa is any aa, unknown or other
  misc_feature (189)..(189): Xaa is any aa, unknown or other
  misc_feature (262)..(262): Xaa is any aa, unknown or other
MAISYNALAQSLPGRSSFFVPKALCIKQRSRSTVVFASNDKNIIALQAKVDTLLDRIKWDEKGLAVAIAQNVDTGAVLMQGFANREALSTTLTSRKATFFSRSRSTLWTKGETSNNFINVLDVYLDXDXDSIIYLGTPDGPTCHTGAETCYYTSVLDQLXNDEAXGEKLASTTLYSLESIISKRKEESXVPQEGKPSWTRRLLTDDALLCSKIREEADELCRTLEDKEEVSRTASEMADMLYHAMVLLSKRDVKFEDVLEVXRKRFSQSGIEEKQSRSK

SEQ ID NO: 6413 - protein, 281 aa, Glycine max
  misc_feature (1)..(281): useful for making plants with modified plant phenotypes as described in USSN 12/139,269
  misc_feature (1)..(281): Ceres CLONE ID no. 463846
  misc_feature (1)..(281): Utility: Useful for increasing chlorophyll and photosynthetic capacity
  misc_feature (1)..(281): Utility: Useful for making lethal plants for genetic confinement systems
  misc_feature (1)..(281): Utility: Useful for making ornamental plants with modified flowers
  misc_feature (1)..(281): Utility: Useful for making ornamental plants with modified leaves
  misc_feature (1)..(281): Utility: Useful for making plants with altered leaf shape eg curled leaves
  misc_feature (1)..(281): Utility: Useful for making plants with increased biomass
  misc_feature (1)..(281): Utility: Useful for making smaller plants
MAVSYVHMLQCNRGFHKGNLSYPNCSYKARRSHRLVFASMHTPEPKVDSLLDSVKWDTKGLVVAIAQNVDTGAILMQGFANREAIATTISSRKATFYSRSRSTLWTKGETSNNFINVHDVFIDCDRDSIIYLGKPDGPTCHTGAETCYYTSVFDLLKQQEAEENKLALTSLYALESTISQRKTELIGENEKPSWTKRLLLNDKLLCSKIREEANELCQTLENNEDEKRTASEMADVLYHAMVLLAKKGVKIEDVLQVLRLRFSQSGIEEKKSRVSQKSVDD

SEQ ID NO: 6414 - protein, 298 aa, Triticum aestivum
  misc_feature (1)..(298): useful for making plants with modified plant phenotypes as described in USSN 12/139,269
  misc_feature (1)..(298): Ceres CLONE ID no. 788296
  misc_feature (1)..(298): Utility: Useful for increasing chlorophyll and photosynthetic capacity
  misc_feature (1)..(298): Utility: Useful for making lethal plants for genetic confinement systems
  misc_feature (1)..(298): Utility: Useful for making ornamental plants with modified flowers
  misc_feature (1)..(298): Utility: Useful for making ornamental plants with modified leaves
  misc_feature (1)..(298): Utility: Useful for making plants with altered leaf shape eg curled leaves
  misc_feature (1)..(298): Utility: Useful for making plants with increased biomass
  misc_feature (1)..(298): Utility: Useful for making smaller plants
MAAPLPRAPVSSPASRAALCPARSNPCTAAAPSSGALGWRRRQPCPMLSIAPGSARSTPAALAVDPKVEALLDSVKWDVKGLAVAIAQNVDTGAILMQGFANKEALAATISTRKATFYSRSRSSLWTKGETSMNFINVHDIFLDCDRDSIIYLGTPDGPTCHTGAETCYYSSVYDALQGSKSNQERQVTTTLYSLEDTISRRKEEIVTEGSGKPSWTKKLLLDNQLLCSKIREEAGELIQTLLENEEKSRTASEMADLLYHAMVLLSVRDVKMEEVLEVLRKRFSQSGVEEKASRKKS

SEQ ID NO: 6415 - protein, 310 aa, Zea mays
  misc_feature (1)..(310): useful for making plants with modified plant phenotypes as described in USSN 12/139,269
  misc_feature (1)..(310): Ceres CLONE ID no. 303545
  misc_feature (1)..(310): Utility: Useful for increasing chlorophyll and photosynthetic capacity
  misc_feature (1)..(310): Utility: Useful for making lethal plants for genetic confinement systems
  misc_feature (1)..(310): Utility: Useful for making ornamental plants with modified flowers
  misc_feature (1)..(310): Utility: Useful for making ornamental plants with modified leaves
  misc_feature (1)..(310): Utility: Useful for making plants with altered leaf shape eg curled leaves
  misc_feature (1)..(310): Utility: Useful for making plants with increased biomass
  misc_feature (1)..(310): Utility: Useful for making smaller plants
EERNTHTLGFPMAAAAPTHAPVSSSACRSGFSSSDVSFPNFRSAAASAPGWRRREPYPAVSVVSSSPQSVPGAITVDTEVDTLLDSVKWDSKGLAVAIAQNVDTGAILMQGFANKEALAKTISTRKATFFSRSRSSLWTKGETSMNFINVHDIFLDCDHDSIIYLGKPDGPTCHTGAETCYYTSVYDALQSSKPNEGRQVMTTLYSLEDTISRRHEEKVTDGGGKPSWTKKLLLDNQLLCSKIREEAGELIQTLLENEDQSRAASEMADLLYHAMVLLRVKDVKMEQVLEVLRKRFSQSGIEEKASRNKS

SEQ ID NO: 6416 - protein, 202 aa, Zea mays
  misc_feature (1)..(202): useful for making plants with modified plant phenotypes as described in USSN 12/139,269
  misc_feature (1)..(202): Public GI no. 34903270
  misc_feature (1)..(202): Utility: Useful for increasing chlorophyll and photosynthetic capacity
  misc_feature (1)..(202): Utility: Useful for making lethal plants for genetic confinement systems
  misc_feature (1)..(202): Utility: Useful for making ornamental plants with modified flowers
  misc_feature (1)..(202): Utility: Useful for making ornamental plants with modified leaves
  misc_feature (1)..(202): Utility: Useful for making plants with altered leaf shape eg curled leaves
  misc_feature (1)..(202): Utility: Useful for making plants with increased biomass
  misc_feature (1)..(202): Utility: Useful for making smaller plants
MQGFANKEALATTISTRKATFYSRSRSSLWTKGETSMNFINVHDIFLDCDRDSIIYLGKPDGPTCHTGAETCYYTSVYDALQGSKPNQDRQVVSTLYSLEDTISRRKEEIVTEGSGKPSWTKKLILDNRLLCSKISEEAGELNQTLLENEDESRTISEMGDLLYHAMVLLRVKGVRMEQVLEVLRKRFSQSGIEEKASRNKS

SEQ ID NO: 6417 - protein, 306 aa, Zea mays
  misc_feature (1)..(306): useful for making plants with modified plant phenotypes as described in USSN 12/139,269
  misc_feature (1)..(306): Public GI no. 56783703
  misc_feature (1)..(306): Utility: Useful for increasing chlorophyll and photosynthetic capacity
  misc_feature (1)..(306): Utility: Useful for making lethal plants for genetic confinement systems
  misc_feature (1)..(306): Utility: Useful for making ornamental plants with modified flowers
  misc_feature (1)..(306): Utility: Useful for making ornamental plants with modified leaves
  misc_feature (1)..(306): Utility: Useful for making plants with altered leaf shape eg curled leaves
  misc_feature (1)..(306): Utility: Useful for making plants with increased biomass
  misc_feature (1)..(306): Utility: Useful for making smaller plants
MAAPPLPRAPVSSSAAAASPGGRALLLLRVGGGGSGRCAGVAAAAAPGWRRPFPAASVAARSAGTTPGEVAVDPKVEAILDSVKWDSKGLAVAIAQNVDTGAILMQGFANKEALATTISTRKATFYSRSRSSLWTKGETSMNFINVHDIFLDCDRDSIIYLGKPDGPTCHTGAETCYYTSVYDALQGSKPNQDRQVVSTLYSLEDTISRRKEEIVTEGSGKPSWTKKLILDNRLLCSKISEEAGELNQTLLENEDESRTISEMGDLLYHAMVLLRVKGVRMEQVLEVLRKRFSQSGIEEKASRNKS

SEQ ID NO: 6418 - DNA, 1191 bp, Arabidopsis thaliana
  misc_feature (1)..(1191): useful for making plants with modified plant phenotypes as described in USSN 12/139,269
  misc_feature (1)..(1191): Ceres CLONE ID no. 25607
  misc_feature (1)..(1191): Also known as  Ceres CDNA ID no. 23427539
aagacaaaaggagcggtttggtgaagttagttaaaagagttgggtttcttcgtaagcatcgaaatcagatttctttaccaaagaaaaaataaagaaaagaaaaatatagcaagtacactgcatttcaacactctcatatctctccttcctacttcctcggtttcatcgtccactgtctcaacaatggcgtcattgtcggtaccttgcgtcaagatctgtgctctgaacaggcgggtcggatctctccctggaatctctactcaaagatggcagccgcaacccaatgggatctcctttccctccgatgtttctcagaatcattctgcattctggaggttgcgtgcaacaactaatgaggttgtttctaactccactccaatgactaatggtgggtatatgaacggaaaagcgaaaaccaatgttcctgaacccgccgagctctctgaatttatggctaaagtctctggtcttcttaagcttgtggattcaaaagacatagtggaacttgaactaaagcagctcgactgtgagatcgttattcgaaagaaggaagctttacagcaagctgtaccaccagctccagtttatcactcaatgcctcctgtaatggcagacttttcaatgcctccagctcaaccagtggctcttcctccttctcctactcctacctcaacgcctgcaacagcaaaaccaacatccgccccatcctcgtctcatcctccactcaagagtcccatggctggtactttctatagatctcctggacccggtgaacccccttttgtaaaggttggagataaggtacagaagggtcaaattgtttgtattatcgaagctatgaaactgatgaacgagattgaggctgagaagtcaggaaccatcatggaactactggctgaagatggaaaaccagtcagcgttgacacgcctctttttgtcatcgcaccttgaaacgaagaaggatccttttagctgcttcaaaacatcttcaaagtctcggttaagctatagcaacgtgctaaaactcatcaagtaattatttcagcttaagttggttggtttcggatttctgcttgtcgcttcaataattgacccatcttttgggatttcacgtaacgtactacactttgctttttagttttctgcgaaactaatgtattttgtagcctctcaatcctggctctctgtccc

SEQ ID NO: 6419 - protein, 255 aa, Arabidopsis thaliana
  misc_feature (1)..(255): useful for making plants with modified plant phenotypes as described in USSN 12/139,269
  misc_feature (179)..(253): Pfam Name: Biotin_lipoyl; Pfam Description: Biotin-requiring enzyme
  misc_feature (1)..(255): Utility: Useful for increasing chlorophyll and photosynthetic capacity
  misc_feature (1)..(255): Utility: Useful for making larger plants
  misc_feature (1)..(255): Utility: Useful for making plants sterile and for genetic confinement
  misc_feature (1)..(255): Utility: Useful for making plants with increased biomass and foliage
MASLSVPCVKICALNRRVGSLPGISTQRWQPQPNGISFPSDVSQNHSAFWRLRATTNEVVSNSTPMTNGGYMNGKAKTNVPEPAELSEFMAKVSGLLKLVDSKDIVELELKQLDCEIVIRKKEALQQAVPPAPVYHSMPPVMADFSMPPAQPVALPPSPTPTSTPATAKPTSAPSSSHPPLKSPMAGTFYRSPGPGEPPFVKVGDKVQKGQIVCIIEAMKLMNEIEAEKSGTIMELLAEDGKPVSVDTPLFVIAP

SEQ ID NO: 6420 - protein, 260 aa, Arabidopsis thaliana
  misc_feature (1)..(260): useful for making plants with modified plant phenotypes as described in USSN 12/139,269
  misc_feature (1)..(260): Public GI no. 44190488
  misc_feature (1)..(260): Utility: Useful for increasing chlorophyll and photosynthetic capacity
  misc_feature (1)..(260): Utility: Useful for making larger plants
  misc_feature (1)..(260): Utility: Useful for making plants sterile and for genetic confinement
  misc_feature (1)..(260): Utility: Useful for making plants with increased biomass and foliage
MASLSIVPYAKISAPSRRVGSIPGIRRQLKPSGISFHVSHVSQTQSTIWRLHATTNEKVVSNSTPVTNGGCLNGNVKTNVPEPAAELSDFMSKVSSLLKLVDSRDIVELELKQLDCEIVIRKKEALQQQATQPPAPVYHSMMPPPPMAGLPMPPSPPVSPPPSPAPSSAAETAKPATAPSSSHPPLKSPMAGTFYRSPGPGEPPFVKVGDKVRKGQVVCIIEAMKLMNEIEAEKSGTITELLAEDGKPVSVDTPLFTIAP

SEQ ID NO: 6421 - protein, 251 aa, Arabidopsis thaliana
  misc_feature (1)..(251): useful for making plants with modified plant phenotypes as described in USSN 12/139,269
  misc_feature (1)..(251): Public GI no. 1070008
  misc_feature (1)..(251): Utility: Useful for increasing chlorophyll and photosynthetic capacity
  misc_feature (1)..(251): Utility: Useful for making larger plants
  misc_feature (1)..(251): Utility: Useful for making plants sterile and for genetic confinement
  misc_feature (1)..(251): Utility: Useful for making plants with increased biomass and foliage
MASLSVPYAKISAPNRRVESIPGIRRQPQPSGISFHVSHVSQTQSTIWRLRATTNEVVSNSTPVTNGGCLNGNVKTNVPPEPAAELSDFISKVSGLLKLVDSRDIVELELKQLDCEIVIRKRKLTAATAPVYHSMMPPPPMEGLPMPPSPPVSPPAPSSAPATANTATAPSSSHPPLKSPMAGTFYRSPGPGEPPFVKVGDKVQKGQVVCIIEAMKLMNEIEAEKSGTITELLAEDGKPVSVDTPLFTIAP

SEQ ID NO: 6422 - protein, 256 aa, Arabidopsis thaliana
  misc_feature (1)..(256): useful for making plants with modified plant phenotypes as described in USSN 12/139,269
  misc_feature (1)..(256): Public GI no. 1070006
  misc_feature (1)..(256): Utility: Useful for increasing chlorophyll and photosynthetic capacity
  misc_feature (1)..(256): Utility: Useful for making larger plants
  misc_feature (1)..(256): Utility: Useful for making plants sterile and for genetic confinement
  misc_feature (1)..(256): Utility: Useful for making plants with increased biomass and foliage
MASLSVPYAKISAPNRRVGSIPGRTRWQPQLNGVSFPSDVSQNQSTIWRLRATTNEVVSNSTPVTNGGCLNGNVKSNVPESAKLSNFMAKVSGLLKLVDSRDIVELELKQLDCEIVIRKKEALQQQPTPPPAPVYHSMASPMAGLQMAPSQPVAPPPFSLVLSAPETAKPVTPPSSFTSSTQESYGLGTFYRSPGPGEPPFVKVGDKVQKGQVVCIIEAMKLMNEIEAEKSGTITELLAEDGKPVSVDTPLFTIVP

SEQ ID NO: 6423 - protein, 284 aa, Arabidopsis thaliana
  misc_feature (1)..(284): useful for making plants with modified plant phenotypes as described in USSN 12/139,269
  misc_feature (1)..(284): Public GI no. 12006165
  misc_feature (1)..(284): Utility: Useful for increasing chlorophyll and photosynthetic capacity
  misc_feature (1)..(284): Utility: Useful for making larger plants
  misc_feature (1)..(284): Utility: Useful for making plants sterile and for genetic confinement
  misc_feature (1)..(284): Utility: Useful for making plants with increased biomass and foliage
MASFTIPCPKCVVVPFAHLGLNSQTQQRNALGLKKSLSFGSLSSDSAPNGIQCLNKKQSSVWKLQAQPKEAVTVENSAPVQVNGPKIAPPEEKDDHNGKPSGPSTSADASSISAFMNQVSDLVKLVDSKDIMELQLKQANCELVIRKKEALLPPPATFVAPVSQPFPYPTNSLPAAPPPVATSTPASSPSSKAAPALPPAKASKSSHPALKCPMAGTFYRSPAPGEPPFVKVGDKVQKGQVICIIEAMKLMNEIEADQSGTVAEVVAEDGKPVSVDTPLFVIVP

SEQ ID NO: 6424 - protein, 280 aa, Glycine max
  misc_feature (1)..(280): useful for making plants with modified plant phenotypes as described in USSN 12/139,269
  misc_feature (1)..(280): Ceres CLONE ID no. 1243020
  misc_feature (1)..(280): Utility: Useful for increasing chlorophyll and photosynthetic capacity
  misc_feature (1)..(280): Utility: Useful for making larger plants
  misc_feature (1)..(280): Utility: Useful for making plants sterile and for genetic confinement
  misc_feature (1)..(280): Utility: Useful for making plants with increased biomass and foliage
MASFSVPCPKCPTTSSSSSLPLGLNSQKVSFQSGLILKPSLSFGSLSAESAASRIQCLNRKQFSVLKATKVENSNSAPVTVNGPTVASSKENQVHNGKLSDTTIPDEASIIAFMSQVSDLVKLVDSRDIVELQLKQSDCELMIRKKEALQPPPIIAPAPPPMHYATFPSPSSPLPAEAAPASSAPPKAAPALPSPGKASTSSHPPLKCPMAGTFYRSPAPGEPAFVKVGDKVKKGQVICIIEAMKLMNEIEADQSGTIAEVLAEDGKPVSVDMPLFVIVP

SEQ ID NO: 6425 - protein, 262 aa, Glycine max
  misc_feature (1)..(262): useful for making plants with modified plant phenotypes as described in USSN 12/139,269
  misc_feature (1)..(262): Public GI no. 1143319
  misc_feature (1)..(262): Utility: Useful for increasing chlorophyll and photosynthetic capacity
  misc_feature (1)..(262): Utility: Useful for making larger plants
  misc_feature (1)..(262): Utility: Useful for making plants sterile and for genetic confinement
  misc_feature (1)..(262): Utility: Useful for making plants with increased biomass and foliage
MASSLAPATKAATNLRLTHSLRFSPKPNNLRFATKPGNTLLCTRVKAQLNEVALDSSSNATSPPMKAKSKEEPPAKPLAEPSSSVLATQESVSQFITQVASLVKLVDSRDIVELKLKQHDVEVTIRKKEAMPQPPPAPQPSVVYSPPPPALPPPPVPASTPAPTLARATPTPTSAPAVKSAKSSLPPLKSPMAGTFYRSPAPGEPSFVKVGDKVKKGQVVCIIEAMKLMNEIEADQSGTIVEIVAEDAKSVSVDTPLFVIQP

SEQ ID NO: 6426 - protein, 276 aa, Glycine max
  misc_feature (1)..(276): useful for making plants with modified plant phenotypes as described in USSN 12/139,269
  misc_feature (1)..(276): Ceres CLONE ID no. 625652
  misc_feature (1)..(276): Utility: Useful for increasing chlorophyll and photosynthetic capacity
  misc_feature (1)..(276): Utility: Useful for making larger plants
  misc_feature (1)..(276): Utility: Useful for making plants sterile and for genetic confinement
  misc_feature (1)..(276): Utility: Useful for making plants with increased biomass and foliage
MASFSVPCPKCPTTSSSPPLGLKSLNVSFQRVLSLKPSLSFGSLSAESAASRIQCLNRKQFSVLKATKVENSNSAPVMVNGPNVASSKEKEVHNGKLSGGTIPDDASIIAFMSQVSDLVKLVDSRDIVELQLKQSDCELMIRKKEALQPPPVIAPTSPPMHYATVPSPPPPPAAAPASSAPPKAVPALPSPAKAGTSSHPTLKCPMAGTFYRSPAPGEPAFVKVGDKVQKGQVICIIEAMKLMNEIEADQSGTIAEVLAEDGKPVSVDTPLFVIVP

SEQ ID NO: 6427 - protein, 261 aa, Glycine max
  misc_feature (1)..(261): useful for making plants with modified plant phenotypes as described in USSN 12/139,269
  misc_feature (1)..(261): Ceres CLONE ID no. 626132
  misc_feature (1)..(261): Utility: Useful for increasing chlorophyll and photosynthetic capacity
  misc_feature (1)..(261): Utility: Useful for making larger plants
  misc_feature (1)..(261): Utility: Useful for making plants sterile and for genetic confinement
  misc_feature (1)..(261): Utility: Useful for making plants with increased biomass and foliage
MASSLAPATKAATNLRLTHSLRFSPKPNNLRFATKPGNTLLCARVKAQLDEVALDSSSNATPPIKAKSKEEPPAKPLAEPSSSVLATQESVSQFITQVASLVKLVDSRDIVELKLKQHDVEVTIRKKEAMPQPPPPPQPAVVYSSPPPVLPPPSVPASTPAPTLARATPSPTSAPAVKSAKSSLPPLKSPMAGTFYRSPAPGEPPFVKVGDKVKKGQVVCIIEAMKLMNEIEADQSGTIVEIVAEDAKSVSVDTPLFVIQP

SEQ ID NO: 6428 - DNA, 1167 bp, Arabidopsis thaliana
  misc_feature (1)..(1167): useful for making plants with modified plant phenotypes as described in USSN 12/139,269
  misc_feature (1)..(1167): Ceres CLONE ID no. 25758
  misc_feature (1)..(1167): Also known as  Ceres CDNA ID no. 23369666
atatcaatcaatcgaaaaacctttctctcttctttcggagccgtcgcttgtgaaactttccggcgatttaacagagtcatgatggaaatacgaactccgaagactggcaaagccaagcgtgttctcgaaagccgagctcctaagttggttgaaactgggaagaagacgttgatacttcatggaacaaagacgagtgctacacttagctctgtaatgacggaactctaccgtttgaagaagggaggtgccatcagatattcaaggaggaatgagaatattaggcctttcgagagtggaggtgaaacttcattagagttcttctctcagaaaacagattgtagcatttttgtgtatggttctcacacgaagaaacgacctgacaatcttgtacttgggagaatgtatgatcaccaagtctatgatcttatagaagttgggattgagaactttaaatccttgcgggcgttttcgtattacaagaaattcgcacctcatgaaggaacaaagcctttcatttgctttattggtgaaggttttgagaatgtatcagagcttaagcatctcaaagaagtcctcactgatctttttcgtggcgaggttgtggataatctaaatcttactggtttagaccgcgcttacgtatgttcagctatatccccaacaaaggttttccttactcattgcgcattgaagcttaaaaagtcaggatccattgttccgagaatggagcttgttgaagtcagtccatccatggacttggttatcaggcgtaatcgtcttcctaacgatagcttaatgaaagaagcaatgagaacatccaaggataagcctaagaagaaggagaaaaacgttgatcaagatgcagtactagggaagactgggaagatttatatgcctgatcagaagctgaaagaaatgaaactgttcgataaatctaagggatcgaagagagagcggaaagacgctaagcttaagcataaggaagagactgttgccaaaaagatgaaggtgtcttctgagtgactcaacagaccactcttggctctgcatcaacagctttcaatatgtggaagatgaaatgattttgtagtgtaatgagcttggcttttatttttccattagaatctataactgaatgttttctatacgctaatattttattaaggc

SEQ ID NO: 6429 - protein, 314 aa, Arabidopsis thaliana
  misc_feature (1)..(314): useful for making plants with modified plant phenotypes as described in USSN 12/139,269
  misc_feature (31)..(233): Pfam Name: Brix; Pfam Description: Brix domain
  misc_feature (1)..(314): Utility: Useful for increasing chlorophyll and photosynthetic capacity
  misc_feature (1)..(314): Utility: Useful for making ornamental plants with modified flowers
  misc_feature (1)..(314): Utility: Useful for making shorter plants and plants with modified flowers
  misc_feature (1)..(314): Utility: Useful for making smaller plants
MMEIRTPKTGKAKRVLESRAPKLVETGKKTLILHGTKTSATLSSVMTELYRLKKGGAIRYSRRNENIRPFESGGETSLEFFSQKTDCSIFVYGSHTKKRPDNLVLGRMYDHQVYDLIEVGIENFKSLRAFSYYKKFAPHEGTKPFICFIGEGFENVSELKHLKEVLTDLFRGEVVDNLNLTGLDRAYVCSAISPTKVFLTHCALKLKKSGSIVPRMELVEVSPSMDLVIRRNRLPNDSLMKEAMRTSKDKPKKKEKNVDQDAVLGKTGKIYMPDQKLKEMKLFDKSKGSKRERKDAKLKHKEETVAKKMKVSSE

SEQ ID NO: 6430 - protein, 314 aa, Glycine max
  misc_feature (1)..(314): useful for making plants with modified plant phenotypes as described in USSN 12/139,269
  misc_feature (1)..(314): Ceres CLONE ID no. 598129
  misc_feature (1)..(314): Utility: Useful for increasing chlorophyll and photosynthetic capacity
  misc_feature (1)..(314): Utility: Useful for making ornamental plants with modified flowers
  misc_feature (1)..(314): Utility: Useful for making shorter plants and plants with modified flowers
  misc_feature (1)..(314): Utility: Useful for making smaller plants
MLEIKTAKTRKGKRELEKRAPKLVESGKKTLILHGTKTSGVLNAVLAQIYHLKKDCAVKYSRRNENVKPFEAGGETSLEFFSLKTDCSIFVYGSHSKKRPDNLVIGRTYDHHIYDLVEVGVENFKPMESFSYDKKLAPKEGSKPFIVFIGEGFEAVEELKHLKEVLLDLLRGEVVENLNLAGVDRAYVCAALSPNRVFFTHCALRLKKSGTVVPRMELEEVGPSMDFVLRRHRPPNESLRKEALKTSREKPKKKEKNVKKDELQGKIGSIYIPDQKVGETPLPYKAKGVKRERRESKRKNESDGSASKRKKEDS

SEQ ID NO: 6431 - protein, 314 aa, Glycine max; identical to SEQ ID NO: 6430
  misc_feature (1)..(314): useful for making plants with modified plant phenotypes as described in USSN 12/139,269
  misc_feature (1)..(314): Ceres CLONE ID no. 1045071
  misc_feature (1)..(314): Utility: Useful for increasing chlorophyll and photosynthetic capacity
  misc_feature (1)..(314): Utility: Useful for making ornamental plants with modified flowers
  misc_feature (1)..(314): Utility: Useful for making shorter plants and plants with modified flowers
  misc_feature (1)..(314): Utility: Useful for making smaller plants

SEQ ID NO: 6432 - protein, 310 aa, Glycine max
  misc_feature (1)..(310): useful for making plants with modified plant phenotypes as described in USSN 12/139,269
  misc_feature (1)..(310): Public GI no. 34914658
  misc_feature (1)..(310): Utility: Useful for increasing chlorophyll and photosynthetic capacity
  misc_feature (1)..(310): Utility: Useful for making ornamental plants with modified flowers
  misc_feature (1)..(310): Utility: Useful for making shorter plants and plants with modified flowers
  misc_feature (1)..(310): Utility: Useful for making smaller plants
MVAAIRVPRSQRAKRELLKHAPKLVETGKKTLILHGTKTSAVLNSVLADLFHLKRDNAVKYSKKNDNIRPFESGGETSLEFFSLKTDCSLIVYGSHSKKRPNNLVLGRTYDHHIYDLVEVGVENYKSIESYVYDKKLAPKLGSKPFFAFIGEHFESVEELKHLKEVLLDLFKGEVVENLNLAGVDRVFVCTAISPTTVYMMHCALRLKRSGTSIPRIELVEVGPSMDLVVRRHRYPVESLKKEAMKTADHAKKMKNVTKDPVHGKLGKVYIPDQQIAKMSLSNDVKGLKRERREAKKNKDHSKKQKINPE

SEQ ID NO: 6433 - protein, 309 aa, Zea mays
  misc_feature (1)..(309): useful for making plants with modified plant phenotypes as described in USSN 12/139,269
  misc_feature (1)..(309): Ceres CLONE ID no. 246177
  misc_feature (1)..(309): Utility: Useful for increasing chlorophyll and photosynthetic capacity
  misc_feature (1)..(309): Utility: Useful for making ornamental plants with modified flowers
  misc_feature (1)..(309): Utility: Useful for making shorter plants and plants with modified flowers
  misc_feature (1)..(309): Utility: Useful for making smaller plants
MVASIRVPKTQRARRELLKHAPKLVETSKKTLILHGTKTSAVLNSVLSDIYHLKRDNAVKYTKKNDNIRPFESGGESSLEFFSLKADCSLIVYGSHSKKRPNNLILGRTYDHHIYDLVEVGVENYKSMESYVYDKKLAPLLGSKPFFAFIGEHFESAEELKHLKEVLLDLFRGEVVENLNLAGVDRIYVCTAISPTTVYMMHCALRLKRSGTSIPRMELVEVGPSMDLVVRRHRLPAESLKKEAMKTAEHAKKMKNVTKDPVQGKLGKVYMPDQQVGKLTLSNDIKGLKRERREAKKNQDSKKQKVNPE

SEQ ID NO: 6434 - protein, 310 aa, Triticum aestivum
  misc_feature (1)..(310): useful for making plants with modified plant phenotypes as described in USSN 12/139,269
  misc_feature (1)..(310): Ceres CLONE ID no. 616734
  misc_feature (1)..(310): Utility: Useful for increasing chlorophyll and photosynthetic capacity
  misc_feature (1)..(310): Utility: Useful for making ornamental plants with modified flowers
  misc_feature (1)..(310): Utility: Useful for making shorter plants and plants with modified flowers
  misc_feature (1)..(310): Utility: Useful for making smaller plants
MAIRVPKSMRAKRELLKHAPKLVENGKKMLILHGTKTSAVLNSVLADLFHLKRDHAVKYTKKNDSIRPFESGGETSLEFFSLKSDCSLLVYGSHSKKRPNNLVLGRTYDHHIYDLVEVGVENYKSIESYAYDKKLAPKLGTKPFFAFIGEHFESVEGLKHLKEMLLDHFKGEVVENLNLAGVDRIFVCTAISPTTVYMMHCALRLKRSGTSIPRMELVEVGPSVDLVLRRHRQAAESLQKEAMKAPGHAKKVKNVTNNPVEGKQGRIYIPDQEVSKLTVTSNIKGLKRERRDAKKNKEHSKKQKVAENPE

SEQ ID NO: 6435 - DNA, 755 bp, Arabidopsis thaliana
  misc_feature (1)..(755): useful for making plants with modified plant phenotypes as described in USSN 12/139,269
  misc_feature (1)..(755): Ceres CLONE ID no. 25886
  misc_feature (1)..(755): Also known as  Ceres CDNA ID no. 23556709
aagtctacaaaccaaaaacacgctacagaagaagaggaagaagaagaagaagcagagacaagaagaagaagaagaaacagtctcatctcgccggagaagaagaaagatgtcgtggcaatcatacgtcgatgaccatctcatgtgcgaggtcgaaggcaaccacctcacacacgccgccatcttcggccaagacggcagtgtctgggctcagagctcagctttccctcagttgaagcctgcagagatagcaggaatcaacaaagactttgaagaagccggacatcttgccccaaccgggctattccttggcggtgagaagtacatggttgtccaaggtgaggctggagccgtcatccgagggaaaaagggacctggtggagtcactatcaagaagactactcaagctctagtctttggtatctatgatgaacgatgaccggagggcaatgcaacttggtcgtggagaggctcggcgattaccttatcgagtctggtctctaagttcactcaaagtgcttcaaacaaatttcatttttcgggttctttcttcactagagaagcacccttctgccatgtattgtgatttgattgttgttgtgcatcaaacaaagttattatactcttaaaaagaacaaagaaacaatcatatttgttatggttttgatcctctcctatgatggctcttatgtttttctcttgtactgtatttcgtaatgtataattacgctttggaataaaaatttgagtttgtgacc

SEQ ID NO: 6436 - protein, 109 aa, Arabidopsis thaliana
  misc_feature (1)..(109): useful for making plants with modified plant phenotypes as described in USSN 12/139,269
  misc_feature (2)..(108): Pfam Name: Profilin; Pfam Description: Profilin
  misc_feature (1)..(109): Utility: Useful for increasing chlorophyll and photosynthetic capacity
  misc_feature (1)..(109): Utility: Useful for making ornamental plants with modified flowers
  misc_feature (1)..(109): Utility: Useful for making plants sterile and for genetic confinement
  misc_feature (1)..(109): Utility: Useful for making smaller plants
  misc_feature (1)..(109): Utility: Useful for making stronger plants
  misc_feature (87)..(87): Xaa is any aa, unknown or other
MSWQSYVDDHLMCEVEGNHLTHAAIFGQDGSVWAQSSAFPQLKPAEIAGINKDFEEAGHLAPTGLFLGGEKYMVVQGEAGAVIRGKXGPGGVTIKKTTQALVFGIYDER

SEQ ID NO: 6437 - protein, 131 aa, Brassica napus
  misc_feature (1)..(131): useful for making plants with modified plant phenotypes as described in USSN 12/139,269
  misc_feature (1)..(131): Ceres CLONE ID no. 1068409
  misc_feature (1)..(131): Utility: Useful for increasing chlorophyll and photosynthetic capacity
  misc_feature (1)..(131): Utility: Useful for making ornamental plants with modified flowers
  misc_feature (1)..(131): Utility: Useful for making plants sterile and for genetic confinement
  misc_feature (1)..(131): Utility: Useful for making smaller plants
  misc_feature (1)..(131): Utility: Useful for making stronger plants
MSWQSYVDDHLMCDVEGNHLTSAAILGQDGSVWAQSTNFPQLKPAEIEGIKKDFEEPGHLAPTGLFLGGEKYMVVQGEGGAVIRGKKGPGGVTIKKTNQAFVFGIYDEPMTGGQCNLVVERLGDYLIESDL

SEQ ID NO: 6438 - protein, 131 aa, Zea mays; identical to SEQ ID NO: 6437
  misc_feature (1)..(131): useful for making plants with modified plant phenotypes as described in USSN 12/139,269
  misc_feature (1)..(131): Ceres CLONE ID no. 1374642
  misc_feature (1)..(131): Utility: Useful for increasing chlorophyll and photosynthetic capacity
  misc_feature (1)..(131): Utility: Useful for making ornamental plants with modified flowers
  misc_feature (1)..(131): Utility: Useful for making plants sterile and for genetic confinement
  misc_feature (1)..(131): Utility: Useful for making smaller plants
  misc_feature (1)..(131): Utility: Useful for making stronger plants

SEQ ID NO: 6439 - protein, 113 aa, Triticum aestivum
  misc_feature (1)..(113): useful for making plants with modified plant phenotypes as described in USSN 12/139,269
  misc_feature (1)..(113): Ceres CLONE ID no. 1048933
  misc_feature (1)..(113): Utility: Useful for increasing chlorophyll and photosynthetic capacity
  misc_feature (1)..(113): Utility: Useful for making ornamental plants with modified flowers
  misc_feature (1)..(113): Utility: Useful for making plants sterile and for genetic confinement
  misc_feature (1)..(113): Utility: Useful for making smaller plants
  misc_feature (1)..(113): Utility: Useful for making stronger plants
MTILMCDVEGNHLTSAAILGQDGSVWAQSTNFPQLKPAEIEGIKKDFEEPGHLAPTGLFLGGEKYMVVQGEGGAVIRGKKGPGGVTIKKTNQAFVFGIYDEPMTGGQCNLVVE

SEQ ID NO: 6440 - protein, 113 aa, Brassica napus
  misc_feature (1)..(113): useful for making plants with modified plant phenotypes as described in USSN 12/139,269
  misc_feature (1)..(113): Ceres CLONE ID no. 1065662
  misc_feature (1)..(113): Utility: Useful for increasing chlorophyll and photosynthetic capacity
  misc_feature (1)..(113): Utility: Useful for making ornamental plants with modified flowers
  misc_feature (1)..(113): Utility: Useful for making plants sterile and for genetic confinement
  misc_feature (1)..(113): Utility: Useful for making smaller plants
  misc_feature (1)..(113): Utility: Useful for making stronger plants
  misc_feature (20)..(20): Xaa is any aa, unknown or other
MCDVEGNHLTSAAILGQDGXVWAQSTNFPQLKPAEIEGIKKDFEEPGHLAPTGLFLGGEKYMVVQGEGGAVIRGKKGPGGVTIKKTNQAFVFGIYDEPMTGGQCNLVVERLGD

SEQ ID NO: 6441 - protein, 131 aa, Arabidopsis thaliana
  misc_feature (1)..(131): useful for making plants with modified plant phenotypes as described in USSN 12/139,269
  misc_feature (1)..(131): Ceres CLONE ID no. 1350261
  misc_feature (1)..(131): Utility: Useful for increasing chlorophyll and photosynthetic capacity
  misc_feature (1)..(131): Utility: Useful for making ornamental plants with modified flowers
  misc_feature (1)..(131): Utility: Useful for making plants sterile and for genetic confinement
  misc_feature (1)..(131): Utility: Useful for making smaller plants
  misc_feature (1)..(131): Utility: Useful for making stronger plants
MSWQSYVDDHLMCDVEGNHLTAAAILGQDGSVWAQSAKFPQLKPQEIDGIKKDFEEPGFLAPTGLFLGGEKYMVIQGEQGAVIRGKKGPGGVTIKKTNQALVFGFYDEPMTGGQCNLVVERLGDYLIESEL

SEQ ID NO: 6442 - protein, 131 aa, Arabidopsis thaliana; identical to SEQ ID NO: 6441
  misc_feature (1)..(131): useful for making plants with modified plant phenotypes as described in USSN 12/139,269
  misc_feature (1)..(131): Ceres CLONE ID no. 1356804
  misc_feature (1)..(131): Utility: Useful for increasing chlorophyll and photosynthetic capacity
  misc_feature (1)..(131): Utility: Useful for making ornamental plants with modified flowers
  misc_feature (1)..(131): Utility: Useful for making plants sterile and for genetic confinement
  misc_feature (1)..(131): Utility: Useful for making smaller plants
  misc_feature (1)..(131): Utility: Useful for making stronger plants

SEQ ID NO: 6443 - protein, 134 aa, Brassica napus
  misc_feature (1)..(134): useful for making plants with modified plant phenotypes as described in USSN 12/139,269
  misc_feature (1)..(134): Ceres CLONE ID no. 1125290
  misc_feature (1)..(134): Utility: Useful for increasing chlorophyll and photosynthetic capacity
  misc_feature (1)..(134): Utility: Useful for making ornamental plants with modified flowers
  misc_feature (1)..(134): Utility: Useful for making plants sterile and for genetic confinement
  misc_feature (1)..(134): Utility: Useful for making smaller plants
  misc_feature (1)..(134): Utility: Useful for making stronger plants
MSWQSYVDDHLMCDVEGNHLTAAAILGQDGSVWAQSANFPQLKTEEINGITKDFEEPGFLAPTGLFLGGAKYMVIQGEPGAVIRGKKGPGGVTIKKAQPSAHDIFVGNWKPTKNDTLSKRGPTFGTTMNVLYGE

SEQ ID NO: 6444 - protein, 123 aa, Triticum aestivum
  misc_feature (1)..(123): useful for making plants with modified plant phenotypes as described in USSN 12/139,269
  misc_feature (1)..(123): Ceres CLONE ID no. 1030509
  misc_feature (1)..(123): Utility: Useful for increasing chlorophyll and photosynthetic capacity
  misc_feature (1)..(123): Utility: Useful for making ornamental plants with modified flowers
  misc_feature (1)..(123): Utility: Useful for making plants sterile and for genetic confinement
  misc_feature (1)..(123): Utility: Useful for making smaller plants
  misc_feature (1)..(123): Utility: Useful for making stronger plants
  misc_feature (120)..(120): Xaa is any aa, unknown or other
MSWQSYVDDHLMCDVEGNHLTAAAILGQDGSVWAQSANFPQLKTEEINGITKDFEEPGFLAPTGLFLGGAKYMVIQGEPGAVIRGKKGPGGVTIKKTTQALVIGIYEEPMTGGQCNLVVXRLG

SEQ ID NO: 6445 - protein, 131 aa, Brassica napus
  misc_feature (1)..(131): useful for making plants with modified plant phenotypes as described in USSN 12/139,269
  misc_feature (1)..(131): Ceres CLONE ID no. 1128260
  misc_feature (1)..(131): Utility: Useful for increasing chlorophyll and photosynthetic capacity
  misc_feature (1)..(131): Utility: Useful for making ornamental plants with modified flowers
  misc_feature (1)..(131): Utility: Useful for making plants sterile and for genetic confinement
  misc_feature (1)..(131): Utility: Useful for making smaller plants
  misc_feature (1)..(131): Utility: Useful for making stronger plants
  misc_feature (109)..(109): Xaa is any aa, unknown or other
MSWQSYVDDHLMCDVEGNHLTAAAILGQDGSVWAQSANFPQLKTEEINGITKDFEEPGFLAPTGLFLGGAKYMVIQGEPGAVIRGKKGPGGVTIKKTTQALVIGIYEEXMTGGQCNLVVERLGDYLIESDL

SEQ ID NO: 6446 - protein, 131 aa, Zea mays
  misc_feature (1)..(131): useful for making plants with modified plant phenotypes as described in USSN 12/139,269
  misc_feature (1)..(131): Ceres CLONE ID no. 1377743
  misc_feature (1)..(131): Utility: Useful for increasing chlorophyll and photosynthetic capacity
  misc_feature (1)..(131): Utility: Useful for making ornamental plants with modified flowers
  misc_feature (1)..(131): Utility: Useful for making plants sterile and for genetic confinement
  misc_feature (1)..(131): Utility: Useful for making smaller plants
  misc_feature (1)..(131): Utility: Useful for making stronger plants
  misc_feature (30)..(30): Xaa is any aa, unknown or other
  misc_feature (34)..(34): Xaa is any aa, unknown or other
  misc_feature (85)..(85): Xaa is any aa, unknown or other
  misc_feature (123)..(123): Xaa is any aa, unknown or other
MSWQSYVDDHLMCDVEGNHLTAAAILGQDXSVWXQSADFPQLKPEEIKGITTDFEEPGFLAPTGLFLGGAKYMVIQGEPGAVIRXKKGPGGVTIKKTTQALVIGIYEEPMTGGQCNLVVERLXDYLIESDL

SEQ ID NO: 6447 - protein, 131 aa, Glycine max
  misc_feature (1)..(131): useful for making plants with modified plant phenotypes as described in USSN 12/139,269
  misc_feature (1)..(131): Ceres CLONE ID no. 1066115
  misc_feature (1)..(131): Utility: Useful for increasing chlorophyll and photosynthetic capacity
  misc_feature (1)..(131): Utility: Useful for making ornamental plants with modified flowers
  misc_feature (1)..(131): Utility: Useful for making plants sterile and for genetic confinement
  misc_feature (1)..(131): Utility: Useful for making smaller plants
  misc_feature (1)..(131): Utility: Useful for making stronger plants
MSWQTYVDDHLMCDVEGNRLTAAAILGQDGSVWAQSANFPQLKPEEINGINKDFNEPGTLAPTGLFIGGTKYMVIQGEPNAVIRGKKGAGGVTIKKTTQAMVFGIYEEPMTPGQCNMVVERLGDYLIESGL

SEQ ID NO: 6448 - protein, 130 aa, Brassica napus
  misc_feature (1)..(130): useful for making plants with modified plant phenotypes as described in USSN 12/139,269
  misc_feature (1)..(130): Ceres CLONE ID no. 953102
  misc_feature (1)..(130): Utility: Useful for increasing chlorophyll and photosynthetic capacity
  misc_feature (1)..(130): Utility: Useful for making ornamental plants with modified flowers
  misc_feature (1)..(130): Utility: Useful for making plants sterile and for genetic confinement
  misc_feature (1)..(130): Utility: Useful for making smaller plants
  misc_feature (1)..(130): Utility: Useful for making stronger plants
  misc_feature (129)..(129): Xaa is any aa, unknown or other
MPLLHLDAISGTFRLSTEEAEPRKMSWQTYVDDHLMCDVEGNRLTAAAILGQDGSVWAQSANFPQPEEINGINKDFNEPGTLAPTGLFIGGTKYMVIQGEPNAVIRGKKGAGGVTIKKTTQAMVFGIYXE

SEQ ID NO: 6449 - protein, 120 aa, Brassica napus
  misc_feature (1)..(120): useful for making plants with modified plant phenotypes as described in USSN 12/139,269
  misc_feature (1)..(120): Ceres CLONE ID no. 971131
  misc_feature (1)..(120): Utility: Useful for increasing chlorophyll and photosynthetic capacity
  misc_feature (1)..(120): Utility: Useful for making ornamental plants with modified flowers
  misc_feature (1)..(120): Utility: Useful for making plants sterile and for genetic confinement
  misc_feature (1)..(120): Utility: Useful for making smaller plants
  misc_feature (1)..(120): Utility: Useful for making stronger plants
  misc_feature (82)..(82): Xaa is any aa, unknown or other
MSWQTYVDDHLMCDVEGNRLTAAAILGQDGSVWAQSANFPQLKPEEISGINKDFNEPGTLAPTGLFIGGTKYMVIQGEPNTXIRGKKGAGGVTIKKTTQAMVFGIYEEPMTPGQCNMVVE

SEQ ID NO: 6450 - protein, 131 aa, Parthenium argentatum
  misc_feature (1)..(131): useful for making plants with modified plant phenotypes as described in USSN 12/139,269
  misc_feature (1)..(131): Ceres CLONE ID no. 1609975
  misc_feature (1)..(131): Utility: Useful for increasing chlorophyll and photosynthetic capacity
  misc_feature (1)..(131): Utility: Useful for making ornamental plants with modified flowers
  misc_feature (1)..(131): Utility: Useful for making plants sterile and for genetic confinement
  misc_feature (1)..(131): Utility: Useful for making smaller plants
  misc_feature (1)..(131): Utility: Useful for making stronger plants
MSWQAYVDDHLMCEIEGNHLTAAAIIGHDGSVWAQSSNFPQVKPEEITAIMNDFNEPGSLAPTGLHLGGTKYMVIQGEAGAVIRGKKGPGGVTVKKTGMAIIIGIYDEPMTPGQCNMIVERLGDYLLDQGF

SEQ ID NO: 6451 - protein, 131 aa, Zea mays
  misc_feature (1)..(131): useful for making plants with modified plant phenotypes as described in USSN 12/139,269
  misc_feature (1)..(131): Ceres CLONE ID no. 1274796
  misc_feature (1)..(131): Utility: Useful for increasing chlorophyll and photosynthetic capacity
  misc_feature (1)..(131): Utility: Useful for making ornamental plants with modified flowers
  misc_feature (1)..(131): Utility: Useful for making plants sterile and for genetic confinement
  misc_feature (1)..(131): Utility: Useful for making smaller plants
  misc_feature (1)..(131): Utility: Useful for making stronger plants
MSWQTYVDDHLCCEIDGQHLTSAAILGHDGSVWAESPNFPKFKPEEIAGIVKDFEEPGHLAPTGLFLGGTKYMVIQGEPGVVIRGKKGTGGITIKKTGMALILGIYDEPMTPGQCNLVVERLGDYLVEQGF

SEQ ID NO: 6452 - protein, 131 aa, Glycine max; identical to SEQ ID NO: 6451
  misc_feature (1)..(131): useful for making plants with modified plant phenotypes as described in USSN 12/139,269
  misc_feature (1)..(131): Ceres CLONE ID no. 1016548
  misc_feature (1)..(131): Utility: Useful for increasing chlorophyll and photosynthetic capacity
  misc_feature (1)..(131): Utility: Useful for making ornamental plants with modified flowers
  misc_feature (1)..(131): Utility: Useful for making plants sterile and for genetic confinement
  misc_feature (1)..(131): Utility: Useful for making smaller plants
  misc_feature (1)..(131): Utility: Useful for making stronger plants

SEQ ID NO: 6453 - protein, 131 aa, Parthenium argentatum
  misc_feature (1)..(131): useful for making plants with modified plant phenotypes as described in USSN 12/139,269
  misc_feature (1)..(131): Ceres CLONE ID no. 1610119
  misc_feature (1)..(131): Utility: Useful for increasing chlorophyll and photosynthetic capacity
  misc_feature (1)..(131): Utility: Useful for making ornamental plants with modified flowers
  misc_feature (1)..(131): Utility: Useful for making plants sterile and for genetic confinement
  misc_feature (1)..(131): Utility: Useful for making smaller plants
  misc_feature (1)..(131): Utility: Useful for making stronger plants
MSWQAYVDDHLMCEIEGNHLSAAAIIGHDGTVLAQSATFPQVKPEEITAIMNDFNEPGSLAPTGLYLGGTKYMVIQGEAGAVIRGKKGPGGVTIKKTAMSLIIGIYDEPMAPGQCNMIVERLGDYLLEQGF

SEQ ID NO: 6454 - DNA, 799 bp, Arabidopsis thaliana
  misc_feature (1)..(799): useful for making plants with modified plant phenotypes as described in USSN 12/139,269
  misc_feature (1)..(799): Ceres CLONE ID no. 27464
  misc_feature (1)..(799): Also known as  Ceres CDNA ID no. 23388780
acactcctaatccctcccatttttcaaaccactctctctttctctttctctaagtctttaacaatggcgcgccttctcttccgtcttctccaagaagccaattctacatctccggctgaagcttctccgcctttcaactccgacctcgtcctcatccttgcggttcttctttgtgcactgacatgtatcatcggcttaatagccgtctctcgatgcgcttggctccgccgtatcgcctcaagaaacagatcggatcaaactcatccaccgccggtagctgcagccaacaaaggattgaaaaagaaagtcctccggtcgttaccgaaactcacctactcgccggattctccgccggcggagaaactcgtggagtgtgctatctgtttaacggaattcgccgccggagacgagcttagggtgttgccgcagtgtggacatggtttccacgtatcgtgtatcgacacgtggcttggatcacactcttcttgtccttcttgccgtcaaatcttggtggttaccaggtgtcataaatgtggcgggttacccggtagctcaagttcaggacccgaacccgatacccgaatcaaacaacgtgaagatggtcctgataacttcttaccttgattcttttctttagacatatcccattttattttttataaagggaattcgattaaacaaagatataatattaattaaaaagtgttctttatcattttaaaggataatgttactctgtcatgtatatatttaattatctattgtaaatctatcatggaatggaaactttatgtcattc

SEQ ID NO: 6455 - protein, 186 aa, Arabidopsis thaliana
  misc_feature (1)..(186): useful for making plants with modified plant phenotypes as described in USSN 12/139,269
  misc_feature (104)..(145): Pfam Name: zf-C3HC4; Pfam Description: Zinc finger, C3HC4 type (RING finger)
  misc_feature (1)..(186): Utility: Useful for increasing chlorophyll and photosynthetic capacity
  misc_feature (1)..(186): Utility: Useful for making larger plants
  misc_feature (1)..(186): Utility: Useful for making ornamental plants with modified color
  misc_feature (1)..(186): Utility: Useful for making smaller plants
MARLLFRLLQEANSTSPAEASPPFNSDLVLILAVLLCALTCIIGLIAVSRCAWLRRIASRNRSDQTHPPPVAAANKGLKKKVLRSLPKLTYSPDSPPAEKLVECAICLTEFAAGDELRVLPQCGHGFHVSCIDTWLGSHSSCPSCRQILVVTRCHKCGGLPGSSSSGPEPDTRIKQREDGPDNFLP

SEQ ID NO: 6456 - protein, 197 aa, Arabidopsis thaliana
  misc_feature (1)..(197): useful for making plants with modified plant phenotypes as described in USSN 12/139,269
  misc_feature (1)..(197): Public GI no. 15027985
  misc_feature (1)..(197): Utility: Useful for increasing chlorophyll and photosynthetic capacity
  misc_feature (1)..(197): Utility: Useful for making larger plants
  misc_feature (1)..(197): Utility: Useful for making ornamental plants with modified color
  misc_feature (1)..(197): Utility: Useful for making smaller plants
MARLLFRLLVESNTPSPAIDNSTAALNSDLVVILAALLCALICVLGLIAVSRCVWLRRLAAGNRTVSGSQTQSPQPPVAAANKGLKKKVLQSLPKLTFSPESPESEKFAECAICLAEFSAGDELRVLPQCGHGFHVACIDTWLGSHSSCPSCRQILVVARCHKCGGLPGSSSSGLESEPEIEIRIKQGEDDPNSFLP

SEQ ID NO: 6457 - protein, 188 aa, Brassica napus; identical to SEQ ID NO: 978
  misc_feature (1)..(188): useful for making plants with modified plant phenotypes as described in USSN 12/139,269
  misc_feature (1)..(188): Ceres CLONE ID no. 957229
  misc_feature (1)..(188): Utility: Useful for increasing chlorophyll and photosynthetic capacity
  misc_feature (1)..(188): Utility: Useful for making larger plants
  misc_feature (1)..(188): Utility: Useful for making ornamental plants with modified color
  misc_feature (1)..(188): Utility: Useful for making smaller plants
  misc_feature (184)..(184): Xaa is any aa, unknown or other
  misc_feature (186)..(186): Xaa is any aa, unknown or other

SEQ ID NO: 6458 - protein, 184 aa, Glycine max
  misc_feature (1)..(184): useful for making plants with modified plant phenotypes as described in USSN 12/139,269
  misc_feature (1)..(184): Ceres CLONE ID no. 1120324
  misc_feature (1)..(184): Utility: Useful for increasing chlorophyll and photosynthetic capacity
  misc_feature (1)..(184): Utility: Useful for making larger plants
  misc_feature (1)..(184): Utility: Useful for making ornamental plants with modified color
  misc_feature (1)..(184): Utility: Useful for making smaller plants
MTRALRYLGERNSSTDSAVVDSDFVVILAALLCALICVLGLVAVARCGCLRRLRLSSSATTPQSPTSAANKGVKKKVLRSLPKLTATAESAVKFADCAICLTEFAAGDEIRVLPQCGHGFHVSCIDAWLRSHSSCPSCRQILVVSRCDKCGGIPAPASSSSDPPPPDSEARFKGREDDANRFLP

SEQ ID NO: 6459 - protein, 203 aa, Glycine max
  misc_feature (1)..(203): useful for making plants with modified plant phenotypes as described in USSN 12/139,269
  misc_feature (1)..(203): Ceres CLONE ID no. 476765
  misc_feature (1)..(203): Utility: Useful for increasing chlorophyll and photosynthetic capacity
  misc_feature (1)..(203): Utility: Useful for making larger plants
  misc_feature (1)..(203): Utility: Useful for making ornamental plants with modified color
  misc_feature (1)..(203): Utility: Useful for making smaller plants
MTRGLRLLQSAAAPPPEAVAAAVESDFVVILAALLCALICVVGLVAIARCAWLRRGTAGSSAAGAVSSPATANKGLKKKVVNSLPKFTYADDGDRRKWSECAICLTEFGAGDEVRVLPQCGHGFHVACVDTWLASHSSCPSCRAPFAVVARCQKCGHFPAVASASAASESKAVGCDNAAVSAANANRNNVIITNGFSNYGFLP

SEQ ID NO: 6460 - protein, 186 aa, Zea mays
  misc_feature (1)..(186): useful for making plants with modified plant phenotypes as described in USSN 12/139,269
  misc_feature (1)..(186): Ceres CLONE ID no. 1509889
  misc_feature (1)..(186): Utility: Useful for increasing chlorophyll and photosynthetic capacity
  misc_feature (1)..(186): Utility: Useful for making larger plants
  misc_feature (1)..(186): Utility: Useful for making ornamental plants with modified color
  misc_feature (1)..(186): Utility: Useful for making smaller plants
MARILLEAAAGSGPPTDSINSDMILILAGLLCALVCVLGLGLVARCACSWRWAAASRSQPAADATKAANRGVKKEVLRSLPTVTYVPDSGKAKAAAGADECAICLAEFEEGQAMRVLPQCGHAFHAACVDTWLRAHSSCPSCRRVLAAPADLPPGEPCRRCGARPGFRALWKAPAPCSAEGPTFLA

SEQ ID NO: 6461 - protein, 169 aa, Glycine max
  misc_feature (1)..(169): useful for making plants with modified plant phenotypes as described in USSN 12/139,269
  misc_feature (1)..(169): Ceres CLONE ID no. 1369486
  misc_feature (1)..(169): Utility: Useful for increasing chlorophyll and photosynthetic capacity
  misc_feature (1)..(169): Utility: Useful for making larger plants
  misc_feature (1)..(169): Utility: Useful for making ornamental plants with modified color
  misc_feature (1)..(169): Utility: Useful for making smaller plants
MAARRLLEEAVAAGAQQDSLNSDLVLILAGLLCALVCVLGLGLVARCACSRHWARAADAPPGANRGVKKEVLRALPTVRYVADGGEASESDECAICLAEFEDGQDMRVLPQCSHAFHTACVDAWLRSHSSCPSCRRVLVAELPRGERSGRCGARPGGLDALLKAVPLCR

SEQ ID NO: 6462 - protein, 184 aa, Glycine max
  misc_feature (1)..(184): useful for making plants with modified plant phenotypes as described in USSN 12/139,269
  misc_feature (1)..(184): Public GI no. 50916178
  misc_feature (1)..(184): Utility: Useful for increasing chlorophyll and photosynthetic capacity
  misc_feature (1)..(184): Utility: Useful for making larger plants
  misc_feature (1)..(184): Utility: Useful for making ornamental plants with modified color
  misc_feature (1)..(184): Utility: Useful for making smaller plants
MRVLVHSAESPATPAAAISIDSDMVVILASLLCALICVAGLALVARCACRRRGAATTTTTTTTTPAATSPAPKGLKKKAIDALPTVSFALKQQQQQAECAICLAEFAGGEELRLLPHCGHAFHVSCIDTWLGTHATCPSCRATVGTSTLFLPLPGRCRRCGEVDLPTLHDFSTATATAHHNTPP

SEQ ID NO: 6463 - DNA, 808 bp, Arabidopsis thaliana
  misc_feature (1)..(808): useful for making plants with modified plant phenotypes as described in USSN 12/139,269
  misc_feature (1)..(808): Ceres CLONE ID no. 28602
  misc_feature (1)..(808): Also known as  Ceres CDNA ID no. 23388764
aatcttttcatcgttttcgtgtgaagtttaaagaagtttgggacccgtaaattctagaagctctggagatttcttgttcaccactataaatacatcatccgagtcaccagctttgctcagaagtagaaatcgaactcgccggaaaatcgtaattagctatctcagcattccaaacatctctttcgctttcgaaatcaaatcgagaatgtcgcttattccaagcttcttcggcaacaacaggcgaagcaacagcatcttcgacccgttctcactcgacgtttgggatccattcaaggaactgcaattcccgtcgtcgctctccggagaaacatcggcgataacgaacgcacgtgtggactggaaagagacggcggaggcgcacgtgttcaaggccgatctgccggggatgaagaaagaggaggttaaagtggagatagaggacgacagtgtgctcaagatcagtggagagagacacgtggagaaagaggagaagcaggacacgtggcatcgtgtggagaggtcgagcgggcaattctcgaggaagtttaagctgccggagaatgtgaagatggatcaagtcaaggcttccatggagaacggagttctgactgtgacggtgcctaaagtggaagaggctaagaagaaggctcaagttaagtctattgatatctctggctaaagccaattagcttatgggtttcatgtttatgcgtaaagactcttctgattatggctcttgatttgaatatggctctgtgttttggtaatgatgtattataactgttaatcctaataattaagcaaggcc

SEQ ID NO: 6464 - protein, 157 aa, Arabidopsis thaliana
  misc_feature (1)..(157): useful for making plants with modified plant phenotypes as described in USSN 12/139,269
  misc_feature (51)..(156): Pfam Name: HSP20; Pfam Description: Hsp20/alpha crystallin family
  misc_feature (1)..(157): Utility: Useful for increasing chlorophyll and photosynthetic capacity
  misc_feature (1)..(157): Utility: Useful for making ornamental plants with modified leaves
  misc_feature (1)..(157): Utility: Useful for making plants with altered leaf shape eg curled leaves
  misc_feature (1)..(157): Utility: Useful for making plants with increased biomass and foliage
  misc_feature (1)..(157): Utility: Useful for making smaller plants
  misc_feature (1)..(157): Utility: Useful for making taller plants
MSLIPSFFGNNRRSNSIFDPFSLDVWDPFKELQFPSSLSGETSAITNARVDWKETAEAHVFKADLPGMKKEEVKVEIEDDSVLKISGERHVEKEEKQDTWHRVERSSGQFSRKFKLPENVKMDQVKASMENGVLTVTVPKVEEAKKKAQVKSIDISG

SEQ ID NO: 6465 - protein, 154 aa, Brassica napus
  misc_feature (1)..(154): useful for making plants with modified plant phenotypes as described in USSN 12/139,269
  misc_feature (1)..(154): Ceres CLONE ID no. 969510
  misc_feature (1)..(154): Utility: Useful for increasing chlorophyll and photosynthetic capacity
  misc_feature (1)..(154): Utility: Useful for making ornamental plants with modified leaves
  misc_feature (1)..(154): Utility: Useful for making plants with altered leaf shape eg curled leaves
  misc_feature (1)..(154): Utility: Useful for making plants with increased biomass and foliage
  misc_feature (1)..(154): Utility: Useful for making smaller plants
  misc_feature (1)..(154): Utility: Useful for making taller plants
MIPSFFGNNRRGGSSFFDPFSLDVWDPFKDFPSSSSFSRENSAIVNARVDWRETPDAHVFKADLPGMKKEEVKVEIEDDSVLKISGERHVEKEDKNDTWHRVERSSGQFTRKFRLPENVKMDQVKAAMENGVLTVTVPKAEMKKPDVKSIQISG

SEQ ID NO: 6466 - protein, 157 aa, Parthenium argentatum
  misc_feature (1)..(157): useful for making plants with modified plant phenotypes as described in USSN 12/139,269
  misc_feature (1)..(157): Ceres CLONE ID no. 1608016
  misc_feature (1)..(157): Utility: Useful for increasing chlorophyll and photosynthetic capacity
  misc_feature (1)..(157): Utility: Useful for making ornamental plants with modified leaves
  misc_feature (1)..(157): Utility: Useful for making plants with altered leaf shape eg curled leaves
  misc_feature (1)..(157): Utility: Useful for making plants with increased biomass and foliage
  misc_feature (1)..(157): Utility: Useful for making smaller plants
  misc_feature (1)..(157): Utility: Useful for making taller plants
  misc_feature (117)..(117): Xaa is any aa, unknown or other
MSIIPSAFTGRRSNIFDPFSLDVWDPFQGISNTLSDFPDTSRETAAIANARIDWRETPEAHVFKADLPGMKKEEVKVEVEEGRVLQITGERSREHEEKNDTWHRVERSSGKFFRRFXLPENAKMEHVKASMGDGVLTVTVPKEEEKKPAVKAIDISG

SEQ ID NO: 6467 - protein, 157 aa, Parthenium argentatum
  misc_feature (1)..(157): useful for making plants with modified plant phenotypes as described in USSN 12/139,269
  misc_feature (1)..(157): Ceres CLONE ID no. 1607887
  misc_feature (1)..(157): Utility: Useful for increasing chlorophyll and photosynthetic capacity
  misc_feature (1)..(157): Utility: Useful for making ornamental plants with modified leaves
  misc_feature (1)..(157): Utility: Useful for making plants with altered leaf shape eg curled leaves
  misc_feature (1)..(157): Utility: Useful for making plants with increased biomass and foliage
  misc_feature (1)..(157): Utility: Useful for making smaller plants
  misc_feature (1)..(157): Utility: Useful for making taller plants
MSIIPSFFTGSRSNIFDPFSSEIWDPFQGLSSVINNFPESSRETTAIANARVDWRETPEAHVFKADLPGLKKEEVKVEVEEGRVLQISGESSRENEEKNDKWHRVERSSGRFMRRFRLPENAKMDQVKAAMENGVLTVTVPKAEVKNPAVKAIDISG

SEQ ID NO: 6468 - protein, 131 aa, Zea mays
  misc_feature (1)..(131): useful for making plants with modified plant phenotypes as described in USSN 12/139,269
  misc_feature (1)..(131): Ceres CLONE ID no. 227031
  misc_feature (1)..(131): Utility: Useful for increasing chlorophyll and photosynthetic capacity
  misc_feature (1)..(131): Utility: Useful for making ornamental plants with modified leaves
  misc_feature (1)..(131): Utility: Useful for making plants with altered leaf shape eg curled leaves
  misc_feature (1)..(131): Utility: Useful for making plants with increased biomass and foliage
  misc_feature (1)..(131): Utility: Useful for making smaller plants
  misc_feature (1)..(131): Utility: Useful for making taller plants
MFRSIVPSAASSGGGSETAAFANARVDWKETPEAHVFKADLPGIKKEEVKVEVEDGNVLVISGKRSREEEDKNDKWHRVERSSGQFMRRFRLPENAKVDEVKAGLENGVLTVTVPKTEVKKPEVKAIEISG

SEQ ID NO: 6469 - protein, 132 aa, Glycine max
  misc_feature (1)..(132): useful for making plants with modified plant phenotypes as described in USSN 12/139,269
  misc_feature (1)..(132): Ceres CLONE ID no. 1069458
  misc_feature (1)..(132): Utility: Useful for increasing chlorophyll and photosynthetic capacity
  misc_feature (1)..(132): Utility: Useful for making ornamental plants with modified leaves
  misc_feature (1)..(132): Utility: Useful for making plants with altered leaf shape eg curled leaves
  misc_feature (1)..(132): Utility: Useful for making plants with increased biomass and foliage
  misc_feature (1)..(132): Utility: Useful for making smaller plants
  misc_feature (1)..(132): Utility: Useful for making taller plants
MWDPFKDFHVPTSSVSAENSAFVNTRVDWKETQEAHVLKADIPGLKKEEVKVQIEDDRVLQISGERNVEKEDKNDTWHRVDRSSGKFMRRFRLPENAKVEQVKACMENGVLTVTIPKEEVKKSDVKPIEISG

SEQ ID NO: 6470 - protein, 131 aa, Zea mays
  misc_feature (1)..(131): useful for making plants with modified plant phenotypes as described in USSN 12/139,269
  misc_feature (1)..(131): Ceres CLONE ID no. 212187
  misc_feature (1)..(131): Utility: Useful for increasing chlorophyll and photosynthetic capacity
  misc_feature (1)..(131): Utility: Useful for making ornamental plants with modified leaves
  misc_feature (1)..(131): Utility: Useful for making plants with altered leaf shape eg curled leaves
  misc_feature (1)..(131): Utility: Useful for making plants with increased biomass and foliage
  misc_feature (1)..(131): Utility: Useful for making smaller plants
  misc_feature (1)..(131): Utility: Useful for making taller plants
MFRSIVPPSLSSSAASETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISV

SEQ ID NO: 6471 - protein, 138 aa, Zea mays
  misc_feature (1)..(138): useful for making plants with modified plant phenotypes as described in USSN 12/139,269
  misc_feature (1)..(138): Ceres CLONE ID no. 317418
  misc_feature (1)..(138): Utility: Useful for increasing chlorophyll and photosynthetic capacity
  misc_feature (1)..(138): Utility: Useful for making ornamental plants with modified leaves
  misc_feature (1)..(138): Utility: Useful for making plants with altered leaf shape eg curled leaves
  misc_feature (1)..(138): Utility: Useful for making plants with increased biomass and foliage
  misc_feature (1)..(138): Utility: Useful for making smaller plants
  misc_feature (1)..(138): Utility: Useful for making taller plants
MDLWDPFDTMFRSIVPSAASTNSETAVFASARIDWKETPEAHVFKADLPGVKKEEIKVEVEDGNVLVISGQRSREKEDKDDKWHRVERSSGQFVRRFRLPENAKVDQVKAGLENGVLTVTVPKAEEKKPEVKAIEISG

SEQ ID NO: 6472 - protein, 151 aa, Triticum aestivum
  misc_feature (1)..(151): useful for making plants with modified plant phenotypes as described in USSN 12/139,269
  misc_feature (1)..(151): Ceres CLONE ID no. 1321295
  misc_feature (1)..(151): Utility: Useful for increasing chlorophyll and photosynthetic capacity
  misc_feature (1)..(151): Utility: Useful for making ornamental plants with modified leaves
  misc_feature (1)..(151): Utility: Useful for making plants with altered leaf shape eg curled leaves
  misc_feature (1)..(151): Utility: Useful for making plants with increased biomass and foliage
  misc_feature (1)..(151): Utility: Useful for making smaller plants
  misc_feature (1)..(151): Utility: Useful for making taller plants
MSIVRRSNVFDPFADLWADPFDTFRSIVPAISGGTSETAAFANARVDWKETPEAHVFKADLPGVKKEEVKVEVEDGNVLVVSGERTKEKEDKNDKWHRVERSSGKFVRRFRLPEDAKVEEVKAGLENGVLTVTVPKAEVKKPEVKAIEISG

SEQ ID NO: 6473 - protein, 152 aa, Zea mays
  misc_feature (1)..(152): useful for making plants with modified plant phenotypes as described in USSN 12/139,269
  misc_feature (1)..(152): Ceres CLONE ID no. 1555466
  misc_feature (1)..(152): Utility: Useful for increasing chlorophyll and photosynthetic capacity
  misc_feature (1)..(152): Utility: Useful for making ornamental plants with modified leaves
  misc_feature (1)..(152): Utility: Useful for making plants with altered leaf shape eg curled leaves
  misc_feature (1)..(152): Utility: Useful for making plants with increased biomass and foliage
  misc_feature (1)..(152): Utility: Useful for making smaller plants
  misc_feature (1)..(152): Utility: Useful for making taller plants
  misc_feature (88)..(88): Xaa is any aa, unknown or other
  misc_feature (104)..(104): Xaa is any aa, unknown or other
  misc_feature (117)..(117): Xaa is any aa, unknown or other
  misc_feature (122)..(122): Xaa is any aa, unknown or other
  misc_feature (126)..(126): Xaa is any aa, unknown or other
  misc_feature (128)..(128): Xaa is any aa, unknown or other
  misc_feature (150)..(150): Xaa is any aa, unknown or other
MSLVRRSNVFDPFSMDLWDPFDTMFRSIVPSATSTNSETAAFASARIDWKETPEAHVFKADLPGVKKEEVKVEVEDGNMLVISGQRSXEKEDKDDKWHRVERSXGQFVRRFRLPENXKVDQXKAGXEXGVLTVTVPKAEEKKPEVKAIEXSG

SEQ ID NO: 6474 - protein, 152 aa, Zea mays
  misc_feature (1)..(152): useful for making plants with modified plant phenotypes as described in USSN 12/139,269
  misc_feature (1)..(152): Ceres CLONE ID no. 276371
  misc_feature (1)..(152): Utility: Useful for increasing chlorophyll and photosynthetic capacity
  misc_feature (1)..(152): Utility: Useful for making ornamental plants with modified leaves
  misc_feature (1)..(152): Utility: Useful for making plants with altered leaf shape eg curled leaves
  misc_feature (1)..(152): Utility: Useful for making plants with increased biomass and foliage
  misc_feature (1)..(152): Utility: Useful for making smaller plants
  misc_feature (1)..(152): Utility: Useful for making taller plants
MSLVRRSSVFDPFSVDLFDPFDSMFRSIVPSSSSSGSETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISG

SEQ ID NO: 6475 - protein, 151 aa, Triticum aestivum
  misc_feature (1)..(151): useful for making plants with modified plant phenotypes as described in USSN 12/139,269
  misc_feature (1)..(151): Ceres CLONE ID no. 840867
  misc_feature (1)..(151): Utility: Useful for increasing chlorophyll and photosynthetic capacity
  misc_feature (1)..(151): Utility: Useful for making ornamental plants with modified leaves
  misc_feature (1)..(151): Utility: Useful for making plants with altered leaf shape eg curled leaves
  misc_feature (1)..(151): Utility: Useful for making plants with increased biomass and foliage
  misc_feature (1)..(151): Utility: Useful for making smaller plants
  misc_feature (1)..(151): Utility: Useful for making taller plants
MSIVRRSNVFDPFADLWADPFDTFRSIVPAISGGSSETAAFANARVDWKETPEAHVFKVDLPGVKKEEVKVEVEDGNVLVVSGERSREKEDKNDKWHRVERSSGKFVRRFRLPEDAKVEEVKAGLENGVLTVTVPKAEVKKPEVKAIEISG

SEQ ID NO: 6476 - protein, 154 aa, Zea mays
  misc_feature (1)..(154): useful for making plants with modified plant phenotypes as described in USSN 12/139,269
  misc_feature (1)..(154): Ceres CLONE ID no. 996541
  misc_feature (1)..(154): Utility: Useful for increasing chlorophyll and photosynthetic capacity
  misc_feature (1)..(154): Utility: Useful for making ornamental plants with modified leaves
  misc_feature (1)..(154): Utility: Useful for making plants with altered leaf shape eg curled leaves
  misc_feature (1)..(154): Utility: Useful for making plants with increased biomass and foliage
  misc_feature (1)..(154): Utility: Useful for making smaller plants
  misc_feature (1)..(154): Utility: Useful for making taller plants
MSLVRRSSVFDPFSVDLFDPFDSMFRSIVPSPSSAAAASETAAFASARIDWKETPEAHVFKADLPGVKKEEVKVEVEDGNVLLISGQRSREKEDKGDKWHRVERSSGQFVRRFRLPENAKTEEVRAALENGVLTVTVPKAEVKKPEVKSIQISG

SEQ ID NO: 6477 - DNA, 1541 bp, Arabidopsis thaliana
  misc_feature (1)..(1541): useful for making plants with modified plant phenotypes as described in USSN 12/139,269
  misc_feature (1)..(1541): Ceres CLONE ID no. 35493
  misc_feature (1)..(1541): Also known as  Ceres CDNA ID no. 23360414
ctctttcgaactctccgtcacttccatttcatttctatttgaatcttctcaaagctacacagatctctggaatcgaaaaagcttgagctgtgttaatggcggaggagaaatgggtggtgatggtgacggcgcagactccaacgaatatcgccgtgattaagtattggggaaagagagatgaggttcggattcttcccattaatgatagcattagcgtcacgcttgatcctgatcacctctgtactctcaccaccgtcgctgttagtccttcctttgatcgagatcgaatgtggctcaatggcaaggaaatctcgctttctggaagtaggtaccagaattgcttgagggaaattcgaagtcgtgctgatgatgtagaagataaagaaaagggtatcaagattgcgaagaaagattgggagaagctgcatctgcacattgcttctcataacaacttccctactgctgctggcttagcatcttctgctgctggttttgcttgcttagtttttgctcttgccaagttgatgaatgtaaatgaagatccaagccaactttctgctatagcaaggcaaggttcaggaagtgcttgccgtagtttatttgggggatttgtcaagtggaatatgggaaacaaagaagatggaagtgacagtgttgcagttcaactggtagatgataagcactgggatgatcttgttatcattattgctgtggttagttcacgacagaaggaaacaagcagcacctcgggaatgcgtgagagtgttgagacaagtttgcttttacagcatagagcaaaggaagttgtcccagtacggattttgcaaatggaagaagctataaagaatcgagatttcacatcttttacaaaattgacgtgttcagacagtaatcagtttcatgctgtttgtatggatacatctccacccatattctacatgaatgacacctcccacaggataatcagcttagttgaaaagtggaaccgttctgccggtacaccagagattgcttatacatttgatgctggcccaaatgcagtcatgattgcaagaaacaggaaagtagcagttgaattgctgcaggggctgctctactgcttccctcctaagcctgacacagacatgaagagttacgtactgggggatacatcgatagtaaaagaggcaggcttggaaggagagcttccacaaggaattaaagacaaaattggaagtcaggatcaaaaaggtgaagtgagttattttatatgcagcagacctggaagaggtcctgtggtgcttcaagaccaaactcaagctcttctccatcctcaaactggcctccccaaataaccatttctatgtcttgttgttacttcaactctgagatttgcaacagcttcatcttttgctttgccagctccaactcttgtcctaagagagcactcttctgaatcttttcccaattatttgtgtttacgtacaattcttctgcatcgggtgcaaaaaacaaaacaatcaatattgcaaacgaataagatcttgatgctaaatctgagt

SEQ ID NO: 6478 - protein, 412 aa, Arabidopsis thaliana
  misc_feature (1)..(412): useful for making plants with modified plant phenotypes as described in USSN 12/139,269
  misc_feature (111)..(323): Pfam Name: GHMP_kinases; Pfam Description: GHMP kinases putative ATP-binding protein
  misc_feature (1)..(412): Utility: Useful for increasing chlorophyll and photosynthetic capacity
  misc_feature (1)..(412): Utility: Useful for making plants with increased biomass and foliage
MAEEKWVVMVTAQTPTNIAVIKYWGKRDEVRILPINDSISVTLDPDHLCTLTTVAVSPSFDRDRMWLNGKEISLSGSRYQNCLREIRSRADDVEDKEKGIKIAKKDWEKLHLHIASHNNFPTAAGLASSAAGFACLVFALAKLMNVNEDPSQLSAIARQGSGSACRSLFGGFVKWNMGNKEDGSDSVAVQLVDDKHWDDLVIIIAVVSSRQKETSSTSGMRESVETSLLLQHRAKEVVPVRILQMEEAIKNRDFTSFTKLTCSDSNQFHAVCMDTSPPIFYMNDTSHRIISLVEKWNRSAGTPEIAYTFDAGPNAVMIARNRKVAVELLQGLLYCFPPKPDTDMKSYVLGDTSIVKEAGLEGELPQGIKDKIGSQDQKGEVSYFICSRPGRGPVVLQDQTQALLHPQTGLPK

SEQ ID NO: 6479 - protein, 419 aa, Arabidopsis thaliana
  misc_feature (1)..(419): useful for making plants with modified plant phenotypes as described in USSN 12/139,269
  misc_feature (1)..(419): Public GI no. 18410026
  misc_feature (1)..(419): Utility: Useful for increasing chlorophyll and photosynthetic capacity
  misc_feature (1)..(419): Utility: Useful for making plants with increased biomass and foliage
MATEKWVFMVTAQTPTNIAVIKYWGKRDEVRILPVNDSISVTLDPDHLCTVTTVAVSPAFDRDRMWLNGKEISLSGSRYQNCLREIRGRAGDVEDMEKGIKIRKKDWEKLNLHIASHNNFPTAAGLASSAAGFACLVFSLAKLMNVDEDPSHLSAIARQGSGSACRSLFGGFVKWTMGSKEDGSDSVAVQLADEKHWDDLVIIIAVVSSRQKETSSTSGMRESVETSLLLQHRAKEVVPKRILQMEEAIKNRDFASFTQLTCTDSNQFHAVCLDTSPPIFYMNDTSHRIISLVEKWNRSEGTPQVAYTFDAGPNAVLIARNRKVAVQLLQGLLYYFPPKSDTDMKSYVVGDNSILKEAGLDGASGVENLQPPPEIKDNIGSQDQKGEVSYFICTRPGKGPIVLHDQTQALLDPETGLPK

SEQ ID NO: 6480 - protein, 413 aa, Arabidopsis thaliana
  misc_feature (1)..(413): useful for making plants with modified plant phenotypes as described in USSN 12/139,269
  misc_feature (1)..(413): Public GI no. 6822071
  misc_feature (1)..(413): Utility: Useful for increasing chlorophyll and photosynthetic capacity
  misc_feature (1)..(413): Utility: Useful for making plants with increased biomass and foliage
MATEKWVFMVTAQTPTNIAVIKYWGKRDEVRILPVNDSISVTLDPDHLCTVTTVAVSPAFDRDRMWLNGKEISLSGSRYQNCLREIRGRAGDVEDMEKGIKIRKKDWEKLNLHIASHNNFPTAAGLASSAAGFACLVFSLAKLMNVDEDPSHLSAIARQGSGSACRSLFGGFVKWTMGSKEDGSDSVAVQLADEKHWDDLVIIIAVETSSTSGMRESVETSLLLQHRAKEVVPKRILQMEEAIKNRDFASFTQLTCTDSNQFHAVCLDTSPPIFYMNDTSHRIISLVEKWNRSEGTPQVAYTFDAGPNAVLIARNRKVAVQLLQGLLYYFPPKSDTDMKSYVVGDNSILKEAGLDGASGVENLQPPPEIKDNIGSQDQKGEVSYFICTRPGKGPIVLHDQTQALLDPETGLPK

SEQ ID NO: 6481 - protein, 419 aa, Arabidopsis thaliana
  misc_feature (1)..(419): useful for making plants with modified plant phenotypes as described in USSN 12/139,269
  misc_feature (1)..(419): Public GI no. 21593243
  misc_feature (1)..(419): Utility: Useful for increasing chlorophyll and photosynthetic capacity
  misc_feature (1)..(419): Utility: Useful for making plants with increased biomass and foliage
MATEKWVFMVTAQTPTNIAVIKYWGKRHEVRILPVNDSISVTLDPDHLCTVTTVAVSPAFDRDRMWLNGKEISLSGSRYQNCLREIRGRAGDVEDMEKGIKIRKKDWEKLNLHIASHNNFPTAAGLASSAAGFACLVFSLAKLMNVDEDPSHLSAIARQGSGSACRSLFGGFVKWTMGSKEDGSDSVAVQLADEKHWDDLVIIIAVVSSRQKETSSTSGMRESVETSLLLQHRAKEVVPKRILQMEEAIKNRDFASFTQLTCTDSNQFHAVCLDTSPPIFYMNDTSHRIISLVEKWNRSEGTPQVAYTFDAGPNAVLIARNRKVAVQLLQGLLYYFPPKSDTDMKSYVVGDNSILKEAGLDGASGVENLQPPPEIKDNIGSQDQKGEVSYFICTRPGKGPIVLHDQTQALLDPETGLPK

SEQ ID NO: 6482 - protein, 324 aa, Arabidopsis thaliana
  misc_feature (1)..(324): useful for making plants with modified plant phenotypes as described in USSN 12/139,269
  misc_feature (1)..(324): Ceres CLONE ID no. 37377
  misc_feature (1)..(324): Utility: Useful for increasing chlorophyll and photosynthetic capacity
  misc_feature (1)..(324): Utility: Useful for making plants with increased biomass and foliage
  misc_feature (191)..(191): Xaa is any aa, unknown or other
MEKGIKIRKKDWEKLNLHIASHNNFPTAAGLASSAAGFACLVFSLAKLMNVDEDPSHLSAIARQGSGSACRSLFGGFVKWTMGSKEDGSDSVAVQLADEKHWDDLVIIIAVVSSRQKETSSTSGMRESVETSLLLQHRAKEVVPKRILQMEEAIKNRDFASFTQLTCTDSNQFHAVCLDTSPPIFYMNDTXHRIISLVEKWNRSEGTPQVAYTFDAGPNAVLIARNRKVAVQLLQGLLYYFPPKSDTDMKSYVVGDNSILKEAGLDGASGVENLQPPPEIKDNIGSQDQKGEVSYFICTRPGKGPIVLHDQTQALLDPETGLPK

SEQ ID NO: 6483 - protein, 415 aa, Arabidopsis thaliana
  misc_feature (1)..(415): useful for making plants with modified plant phenotypes as described in USSN 12/139,269
  misc_feature (1)..(415): Public GI no. 16417950
  misc_feature (1)..(415): Utility: Useful for increasing chlorophyll and photosynthetic capacity
  misc_feature (1)..(415): Utility: Useful for making plants with increased biomass and foliage
MAESWVIMVTAQTPTNIAVIKYWGKRDEKLILPVNDSISVTLDPAHLCTTTTVAVSPSFAQDRMWLNGKEISLSGGRYQNCLREIRARACDVEDKERGIKISKKDWEKLYVHIASYNNFPTAAGLASSAAGFACLVFALAKLMNAKEDNSELSAIARQGSGSACRSLFGGFVKWKMGKVEDGSDSLAVQVVDEKHWDDLVIIIAVVSSRQKETSSTTGMRETVETSLLLQHRAKEIVPKRIVQMEESIKNRNFASFAHLTCADSNQFHAVCMDTCPPIFYMNDTSHRIISCVEKWNRSVGTPQVAYTFDAGPNAVLIAHNRKAAAQLLQKLLFYFPPNSDTELNSYVLGDKSILKDAGIEDLKDVEALPPPPEIKDAPRYKGDVSYFICTRPGQGPVLLSDESQALLSPETGLPK

SEQ ID NO: 6484 - protein, 421 aa, Glycine max
  misc_feature (1)..(421): useful for making plants with modified plant phenotypes as described in USSN 12/139,269
  misc_feature (1)..(421): Ceres CLONE ID no. 464546
  misc_feature (1)..(421): Utility: Useful for increasing chlorophyll and photosynthetic capacity
  misc_feature (1)..(421): Utility: Useful for making plants with increased biomass and foliage
MMASESQNWVFMVTAQTPTNIAVIKYWGKRDETLILPVNDSISVTLDPSHLCTTTTAAVSPAFHQDRMWLNGKEISLSGGRFQSCLREIRARACDVEDETKGIKITKEDWGKLHVHIASYNNFPTAAGLASSAAGFACLAYALGKLMNVKEDESQLSAIARQGSGSACRSLFGGFVKWIMGKEDNGSDSLAVQLTDEKHWDDLVIVIAVVSSRQKETSSTTGMRESVETSLLLQHRAKEIVPKRILQMEEAIKNRDFASFSQLTCADSNQFHAVCLDTCPPIFYMNDTSHRIISIVEKWNRSEEAPQVAYTFDAGPNAVLIARNRKAATSLIQRLLYYFPPNSDDLSSYIIGDKSIAKDAGINGIQDVEALPPPPEIKDNIPSQKYKGDVSYFICTRPGRGPVLLSDSIQALLNDETGLPK

SEQ ID NO: 6485 - protein, 420 aa, Zea mays
  misc_feature (1)..(420): useful for making plants with modified plant phenotypes as described in USSN 12/139,269
  misc_feature (1)..(420): Ceres CLONE ID no. 244285
  misc_feature (1)..(420): Utility: Useful for increasing chlorophyll and photosynthetic capacity
  misc_feature (1)..(420): Utility: Useful for making plants with increased biomass and foliage
MAAAEGQWVLMATGRTPTNIAVIKYWGKRDEALILPINDSISVTLDPDHLSATTTVAVSPSFPSDRMWLNGKEISLLGGRFQSCLREIRKRARDFEDKEKGVKIKKEDWDKLHVHIASYNNFPTAAGLASSAAGLACFVFTLGKLMNAKEDYGELSSIARQGSGSACRSIYGGFVKWCMGEKDDGSDSIAVQLADETHWNDLVIIIAVVSSKQKETSSTSGMRDSVETSPLLQYRAQTVVPGRVLKMEEAIKNRDFESFAKLTCADSNQFHAVCLDTSPPIFYMNDTSHRIISLVEKWNHSEGTPQVAYTFDAGPNAVLIAQNRKTAAHLLQKLLYYFPPQDNDLSSYLVGDKSILGVAGLHSMKDVEALPAPPETKIPDQKFKGDVSYFICSRLGAGPKVVSDEGQALIDSVTGLPKGV

SEQ ID NO: 6486 - protein, 420 aa, Triticum aestivum
  misc_feature (1)..(420): useful for making plants with modified plant phenotypes as described in USSN 12/139,269
  misc_feature (1)..(420): Ceres CLONE ID no. 696587
  misc_feature (1)..(420): Utility: Useful for increasing chlorophyll and photosynthetic capacity
  misc_feature (1)..(420): Utility: Useful for making plants with increased biomass and foliage
MGATEPQWVLMATGRSPTNIAVIKYWGKRDETLILPVNDSISVTLDPDHLSATTTVAASPSFPSDRMWLNGKEIALSGGRFQSCLREIRKRARDVEDEKKGIKIKKEDWEKLHVHIASYNNFPTAAGLASSAAGLACLVFTLGKLMNVNEDYGELSSIARQGSGSACRSIYGGFVKWCMGKNDDGSDSMAVQLADESHWDDLVIIIAVVSSKQKETSSTSGMRDTVETSPLLQYRAQTVVPSRILKMEDAIKNRDFESFARLTCADSNQFHAVCLDTSPPIFYMNDTSHRIISLVEKWNHSEGTPQVAYTFDAGPNAVLIARNRKTATLLLQRLLYTFPPQKNDLDSYMLGDKSILSDAGLQSIADVEALPAPPEMKAPNQKFKGDVSYFICSRPGAGPKVLTDESHALIDSATGLAKGV

SEQ ID NO: 6487 - protein, 421 aa, Triticum aestivum
  misc_feature (1)..(421): useful for making plants with modified plant phenotypes as described in USSN 12/139,269
  misc_feature (1)..(421): Public GI no. 50252009
  misc_feature (1)..(421): Utility: Useful for increasing chlorophyll and photosynthetic capacity
  misc_feature (1)..(421): Utility: Useful for making plants with increased biomass and foliage
MAAAEEGQWVLMATGRSPTNIAVIKYWGKRDEALILPVNDSISVTLDPDHLSATTTVAVSPSFPSDRMWLNGKEISLSGGRFQSCLREIRKRAQDVEDEKKGIRIKKEDWGKLHVHIASFNNFPTAAGLASSAAGLACFVFTLGKLMNVKEDHGELSSIARQGSGSACRSIYGGFVKWCMGKNNDGSDSIAVQLADEAHWNDLVIIIAVVSSKQKETSSTSGMRDSVETSPLLQYRAQTVVPERVLKMEEAIKSRNFESFARLTCADSNQFHAVCLDTSPPIFYMNDTSHRIISLVEKWNQSEGTPQVAYTFDAGPNAVLIAPNRKNATILLQKLLYYFPPQDNDLSSYMVGDKSILSDAGLKSIEDVEALPAPAETKMPSQKFKGDVSYFICSRLGAGPKVVTDESLALIDSVTGLPKGV

SEQ ID NO: 6488 - protein, 351 aa, Zea mays
  misc_feature (1)..(351): useful for making plants with modified plant phenotypes as described in USSN 12/139,269
  misc_feature (1)..(351): Ceres CLONE ID no. 224503
  misc_feature (1)..(351): Utility: Useful for increasing chlorophyll and photosynthetic capacity
  misc_feature (1)..(351): Utility: Useful for making plants with increased biomass and foliage
MARRFSLLGGRFQSCLREIRKRARDFEDKEKGVKIKKEDWDKLHVHIASYNNFPTAAGLASSAAGLACFVFTLGKLMNVKEDYGELSSIARQGSGSACRSIYGGFVKWCMGEKDDGSDSIAVQLADETHWNDLVIIIAVVSSKQKETSSTSGMRDSVETSPLLQYRAQTVVPGRVLKMEEAIKNRDFESFAKLTCADSNQFHAVCLDTSPPIFYMNDTSHRIISLVEKWNHSEGTPQVAYTFDAGPNAVLIAQNRKTAAHFLQKLLYYFPPQDNDLSSYLVGDKSILGDAGLHSMKDVEALPAPPDTKIPDQKFKGDVSYFICSRLGAGPKVVVDEGQALIDSVTGLPKGV

SEQ ID NO: 6489 - protein, 430 aa, Zea mays
  misc_feature (1)..(430): useful for making plants with modified plant phenotypes as described in USSN 12/139,269
  misc_feature (1)..(430): Public GI no. 54292590
  misc_feature (1)..(430): Utility: Useful for increasing chlorophyll and photosynthetic capacity
  misc_feature (1)..(430): Utility: Useful for making plants with increased biomass and foliage
MSGEQRELNSWVFMVTARAPTNIAVIKYWGKRDEKLILPINDSISVTLDPDHLSATTTVAVSPSFSSDRMWLNGKEVSLGGERYQNCLREIRSRGRDVVDEKSGTLIKKEDWQTLHLHIASHNNFPTAAGLASSAAGFACLVYALAKLMDIEERYAGELSAIARQGSGSACRSLYGGFVKWDMGKERDGSDSIAVQLATEEHWEELVILVAVVSSRQKETSSTTGMRESVETSELLHHRAQEVVPKRIVQMQEAIANHDFASFARITCVDSNQFHAVCLDASPPIFYMNDTSHRIINCIEKWNRFEGTPQVSYTFDAGPNAVICAPSRKVAGLLLQRLLYYFPPDSSKELSSYVIGDTSILGEIGLKSMKDVESLIAPPEFRSQNSSSIHPGEVDYFICTRPGKGPIILRNEDQAFFNNKTGFPFRISET

SEQ ID NO: 6490 - DNA, 1273 bp, Arabidopsis thaliana
  misc_feature (1)..(1273): useful for making plants with modified plant phenotypes as described in USSN 12/139,269
  misc_feature (1)..(1273): Ceres CLONE ID no. 37229
  misc_feature (1)..(1273): Also known as  Ceres CDNA ID no. 23389130
aaagatcaggtttcgatttcaccaaaaaccgaacactgtgtcttccgtcctaaagattgtaaagggaaaccgttttcgattttcagagaagatcacacatctttcgtcccttcactgccatacgtgtcgataaagatggcggctatggcggcgaagcttcagttatcggcgaaatctgatcaaagcagtgtgcgattaccgagagtgatcaacctctcccgcgatccaacgactagagtctcgtttccgcgaaatggatcagtttgttccctccacaccaatttctcttctccacatctcgcgaaaccttgcgccggaggtggtggtggtggaagcaccggtaataacggcggcggaagcggaagcggaggaggaggtggtggttttggaggttcagggggtgaagcaagtgaagaatcatctccatggggaccaatagggttattcatccaaggatggagatcaagagttgcagctgatcctcagttcccttttaaggtactaatggaagagatcgtaggacttagcgcttgtgttctcggtgacatggcttcacgacctaatttcggattaaacgagctagatttcgtcttctccacgctcgttgtaggttcgattctcaatttcgtactcatgtacatgttagctcctactgcagcaactcttggctcctctcagactttgcctggaatctttagaaactgtccatcaagccatatgtttgaacagggtagcttcaccgttatgaaccgtttcgggactcttgtgtacaaaggaatggtttttgctagtgtaggattagctgcaggtcttgtaggtactgccatttctaatggggttgattatgctgaggaagaagatggacccgagcttcgaaacgccaaacaaaccgccaccgactgtgcttaattctttaacttgggcaactcatatgggagtgagtgcgaatgcaaggtaccaaacgttgaatgggattgagttcttgctggcaaaggtgttgcccccattggtgtttaagacaagtgtgatagttttgaggtgtgcaaacaatgttgctggaggaatgtcgtttgttttgttggcaaggatgacgggatcacagtcggtggaggagaagacagagatgtcagagatttcagagaaagagaaggatgattgaatctcatcctagtctttcaaggtttttgttcctgtgtgtttttcgccagttcataggcttcttgagttgaaaccatttgtgttggaataaataagatgaatcccttcttaggcc

SEQ ID NO: 6491 - protein, 340 aa, Arabidopsis thaliana
  misc_feature (1)..(340): useful for making plants with modified plant phenotypes as described in USSN 12/139,269
  misc_feature (1)..(340): Utility: Useful for increasing chlorophyll and photosynthetic capacity
  misc_feature (1)..(340): Utility: Useful for making smaller plants
MAAMAAKLQLSAKSDQSSVRLPRVINLSRDPTTRVSFPRNGSVCSLHTNFSSPHLAKPCAGGGGGGSTGNNGGGSGSGGGGGGFGGSGGEASEESSPWGPIGLFIQGWRSRVAADPQFPFKVLMEEIVGLSACVLGDMASRPNFGLNELDFVFSTLVVGSILNFVLMYMLAPTAATLGSSQTLPGIFRNCPSSHMFEQGSFTVMNRFGTLVYKGMVFASVGLAAGLVGTAISNGLIMLRKKMDPSFETPNKPPPTVLNSLTWATHMGVSANARYQTLNGIEFLLAKVLPPLVFKTSVIVLRCANNVAGGMSFVLLARMTGSQSVEEKTEMSEISEKEKDD

SEQ ID NO: 6492 - protein, 339 aa, Arabidopsis thaliana
  misc_feature (1)..(339): useful for making plants with modified plant phenotypes as described in USSN 12/139,269
  misc_feature (1)..(339): Public GI no. 46402460
  misc_feature (1)..(339): Utility: Useful for increasing chlorophyll and photosynthetic capacity
  misc_feature (1)..(339): Utility: Useful for making smaller plants
MAAMAAKLHISTKSDQSNVRLPRLINLSRDPTARVLFPRNGSVSSLHTNFSSPNIMVPCAGGGGGGSIGNHGGGSGSGGGGGGYGGSEEEESSPWGPLGLFIQGWRSRVAADSQFPFKVLMEMLVGVSANVLGDMASRPNFGLNELDFVFSTLVVGSILNFTLMYLLAPSAISHGSSNLLPGIFRSCPSSHMFEQGNFTLMNRFGTLVYKGMVFATVGLAAGLVGTAISNGLIMLRKKIDPSFETPNKPPPTLLNSLTWATHMGVSANVRYQTLNGAEFLLEKSLPPLVFKTSVIALRVVNNVLGGMSFVTLARMTGSQSVEEEKKIEMSEISEKEKED

SEQ ID NO: 6493 - protein, 336 aa, Arabidopsis thaliana
  misc_feature (1)..(336): useful for making plants with modified plant phenotypes as described in USSN 12/139,269
  misc_feature (1)..(336): Ceres CLONE ID no. 1190836
  misc_feature (1)..(336): Utility: Useful for increasing chlorophyll and photosynthetic capacity
  misc_feature (1)..(336): Utility: Useful for making smaller plants
MAAKLHISTKSDQSNVRLPRLINLSRDPTARVLFPRNGSVSSLHTNFSSPNIMVPCAGGGGGGSIGNHGGGSGSGGGGGGYGGSEEEESSPWGPLGLFIQGWRSRVAADSQFPFKVLMEMLVGVSANVLGDMASRPNFGLNELDFVFSTLVVGSILNFTLMYLLAPSAISHGSSNLLPGIFRSCPSSHMFEQGNFTLMNRFGTLVYKGMVFATVGLAAGLVGTAISNGLIMLRKKIDPSFETPNKPPPTLLNSLTWATHMGVSANVRYQTLNGAEFLLEKSLPPLVFKTSVIALRVVNNVLGGMSFVTLARMTGSQSVEEEKKIEMSEISEKEKED

SEQ ID NO: 6494 - protein, 346 aa, Glycine max
  misc_feature (1)..(346): useful for making plants with modified plant phenotypes as described in USSN 12/139,269
  misc_feature (1)..(346): Ceres CLONE ID no. 565532
  misc_feature (1)..(346): Utility: Useful for increasing chlorophyll and photosynthetic capacity
  misc_feature (1)..(346): Utility: Useful for making smaller plants
MAMLRLSPLSGQNHVLSFPSSPSPPPPKLQNRPLYLTNLPHLPQRLKLSFAGGAGGDGVGRGGGSGGGGGGGESWGDDEGKSKDSSLGILGLFLNGWRSRVAADPQFPFKVLMEELVGVSACVLGDMASRPNFGLNELDFVFSTLVVGAILNFTLMYLLAPTMTSSASNLPALFASCPKSHMFEPGAFSLLDRLGTLVYKGTIFSVVGFGAGLVGTTLSNGLIKMRKKMDPTFETPNKPPPTILNALTWAAHMGISSNLRYQTLNGVEFMLERVLNPLAFKSSVLVLRCVNNVLGGMSFVVLARLTGAQSVGGEQKENEVALIAEKEKVVESEREEGLQNNQSTAP

SEQ ID NO: 6495 - protein, 343 aa, Zea mays
  misc_feature (1)..(343): useful for making plants with modified plant phenotypes as described in USSN 12/139,269
  misc_feature (1)..(343): Ceres CLONE ID no. 285684
  misc_feature (1)..(343): Utility: Useful for increasing chlorophyll and photosynthetic capacity
  misc_feature (1)..(343): Utility: Useful for making smaller plants
PPQTKNRRQVLPRAPRLLPAHRAPPRRAHREPLLLPALRQPVVPAPPPVPLPVRPGGQAAPAPAASAPVSHAQHRTRAIPSRPDRHGRRGGGILGLFLAGWAARVAADPQFPFKVLMEELVGVTACVLGDMASRPNFGLNELDFVFSTLVVGSILNFVLMYLLAPTAAASSAASALPSHMFEPGAFSLGSRVATLVSKGATFAVVGFAAGLAGTALSNGLMAMRKRMDPAFETPNKPPPTLLNAATWALHMAGSSNLRYQTLNGVEYMLGKVAPAPVFKASVVVLRCLNNVLGGVSFVLLARLTGAQKSDKPATVAEEKERLIAVGNAAADAIGEARDGEEGK

SEQ ID NO: 6496 - protein, 347 aa, Glycine max
  misc_feature (1)..(347): useful for making plants with modified plant phenotypes as described in USSN 12/139,269
  misc_feature (1)..(347): Ceres CLONE ID no. 513688
  misc_feature (1)..(347): Utility: Useful for increasing chlorophyll and photosynthetic capacity
  misc_feature (1)..(347): Utility: Useful for making smaller plants
MAAMAMLRLSPLSGQNHALSFPSSPSPPPKLQNRPLYLTNLPHLPQRLKLSFAGGDGGDGVGRGGGGGGGGESWGDEGKPKDSSFGILGLFLNGWRSRVAADPQFPFKVLMEELVGVSACVLGDMASRPNFGLNELDFVFSTLVVGAILNFTLMYLLAPTMTSSAASNLPALFASCPKSHMFEPGAFSLLDRLGTLVYKGTIFSVVGFGAGLVGTTLSNGLIKMRKKMDPTFETPNKPPPTFLNALTWAGHMGVSSNLRYQTLNGVEFMLERVLNPLAFKSSVLVLRCVNNVIGGMSFVVLARLTGAQSVGGEQKKENEVALIAEKEKLESEREEGLQNNQSTAPSK

SEQ ID NO: 6497 - protein, 349 aa, Triticum aestivum
  misc_feature (1)..(349): useful for making plants with modified plant phenotypes as described in USSN 12/139,269
  misc_feature (1)..(349): Ceres CLONE ID no. 928014
  misc_feature (1)..(349): Utility: Useful for increasing chlorophyll and photosynthetic capacity
  misc_feature (1)..(349): Utility: Useful for making smaller plants
MAAPTAFAAARFLPSAHLDSSARLAPLRAAPTSNLAFSPLPASSSALLALRSASPSPSGPGGRLPPPPPPRSYGGGGGGSGDAADSGGAGDGAGGRAGILGMFLAGWAARVAADPQFPFKVLMEELVGVTACVLGDMSSRPNFGLNELDFVFSTLVVGSILNFVLMYMLAPTAGVSAAAAAAVSSLPSHMFEPGPYSLGSRFATLLSKGTTFAVVGFGAGLMGTAISNGLIAMRKRMDPAFETPNKAPPTLLNAGTWALHMGISSNLRYQTLNGVEFLLGNVMPPPVFKVAVIALRCMNNVLGGMSFVLLARLTGAQKSDKPASSDSEAKERLIAEGDAIAANVSTEDK

SEQ ID NO: 6498 - protein, 341 aa, Zea mays
  misc_feature (1)..(341): useful for making plants with modified plant phenotypes as described in USSN 12/139,269
  misc_feature (1)..(341): Ceres CLONE ID no. 279840
  misc_feature (1)..(341): Utility: Useful for increasing chlorophyll and photosynthetic capacity
  misc_feature (1)..(341): Utility: Useful for making smaller plants
  misc_feature (113)..(113): Xaa is any aa, unknown or other
MASTAFAAAKYFPAHLDSSPRIAPRRAAPTASLSFSPLSASPSSLLRLRSPCPSGPGGRLPPPPPPRSYGGGGGSGGDAADSGGGRRGGGILGLFLAGWAARVAADPQFPFKXLMEELVGVTACVLGDMASRPNFGLNELDFVFSTLVVGSILNFVLMYLLAPTAAASSAASALPSHMFEPGAFSLGSRVATLVSKGATFAVVGFAAGLAGTALSNGLMAMRKRMDPAFETPNKPPPTLLNAATWALHMAGSSNLRYQTLNGVEYMLGKVAPAPVFKASVVVLRCLNNVLGGVSFVLLARLTGAQKSDKPATVAEEKERLIAVGNAVADAIGEARDGEEGK

SEQ ID NO: 6499 - protein, 348 aa, Zea mays
  misc_feature (1)..(348): useful for making plants with modified plant phenotypes as described in USSN 12/139,269
  misc_feature (1)..(348): Public GI no. 56785038
  misc_feature (1)..(348): Utility: Useful for increasing chlorophyll and photosynthetic capacity
  misc_feature (1)..(348): Utility: Useful for making smaller plants
MASMAFTAAKFLPATAPTHLDSSPRLSPPRAGSLSFSPLSSSSSALLLRLRSPSPSGPSGPGGRLPPPPRSYGGGGGSGDAADSGGSSGGILGIFLAGWAARVAADPQFPFKVLMEELVGVSACVLGDMASRPNFGLNELDFVFSTLVVGSILNFVLMYLLAPTAGASAAASAAASGLPSHMFEAGAYSLGSRVATLLSKGATFAAVGFAAGLAGTAISNGLISLRKRMDPAFETPNKAPPTLLNAATWAIHMGVSSNLRYQTLNGVEYLLANAAPPSVFKVSVVALRCINNVLGGMSFVLLARLTGSQKSDAPAASATAEEEKERLIAVGNDIAADAVGAGRDGEGK

SEQ ID NO: 6500 - DNA, 1211 bp, Arabidopsis thaliana
  misc_feature (1)..(1211): useful for making plants with modified plant phenotypes as described in USSN 12/139,269
  misc_feature (1)..(1211): Ceres CLONE ID no. 37493
  misc_feature (1)..(1211): Also known as  Ceres CDNA ID no. 23370172
aaaaagagaatgggttctaagggagacaacgttgctgtatgtaacatgaagctcgagagacttctcagcatgaaaggtggcaaaggacaagacagctacgccaataactctcaagctcaggcaatgcatgcacggtccatgcttcacctcctagaggaaacacttgaaaatgttcacctcaactcctccgccagtccgccaccgttcacgacggttgatcttggctgttcctccggcgcaaatactgtccacataatcgatttcatagtcaaacatatctctaagaggtttgatgctgccggaatcgaccctccggagttcacagctttcttctccgatctcccaagcaacgacttcaacacgcttttccagcttcttccaccacttgtctctaacacttgcatggaggagtgtcttgctgccgacgggaaccgctcctacttcgtcgctggtgttcccggatcgttttaccggcgactttttccagcgagaaccattgactttttccactctgccttctccttgcattggctctctcaggtgccggaaagtgtgacggataggagatcggcggcgtacaatagagggagagttttcatacacggtgccggagagaagacaacaacggcatacaaacggcagtttcaggccgacttagcggagtttttgagggcaagagcggcagaggttaagagaggtggggccatgttcctggtctgtcttggtcgtacctctgtggatcccaccgaccagggtggtgccggtctactcttcggcactcattttcaggacgcttgggacgaccttgtccgcgagggtttggtagcagcagagaaacgagatggattcaatatcccggtgtacgcaccaagcttgcaagatttcaaggaagtagttgacgccaacggctcatttgcaattgataagctggtagtatacaaaggagggagtccacttgtggtgaatgagccagacgatgcatcagaagttggtcgtgcctttgctagtagttgtcggagtgtggccggagtgctcgtggaagctcacataggcgaagagctaagcaataaactgttctcacgagttgaaagccgagccactagccatgccaaagatgtcttggtgaatttgcagttcttccacattgtcgcttctttgtcttttacttaattagtaccaaataatatgaaaaagaaatatgttcgtgtgcc

SEQ ID NO: 6501 - protein, 386 aa, Arabidopsis thaliana
  misc_feature (1)..(386): useful for making plants with modified plant phenotypes as described in USSN 12/139,269
  misc_feature (48)..(386): Pfam Name: Methyltransf_7; Pfam Description: SAM dependent carboxyl methyltransferase
  misc_feature (1)..(386): Utility: Useful for increasing chlorophyll and photosynthetic capacity
  misc_feature (1)..(386): Utility: Useful for making ornamental plants with modified flowers
  misc_feature (1)..(386): Utility: Useful for making ornamental plants with modified leaves
  misc_feature (1)..(386): Utility: Useful for making plants sterile and for genetic confinement
  misc_feature (1)..(386): Utility: Useful for making plants with altered leaf shape eg curled leaves
  misc_feature (1)..(386): Utility: Useful for making plants with increased biomass and foliage
  misc_feature (1)..(386): Utility: Useful for making smaller plants
MGSKGDNVAVCNMKLERLLSMKGGKGQDSYANNSQAQAMHARSMLHLLEETLENVHLNSSASPPPFTTVDLGCSSGANTVHIIDFIVKHISKRFDAAGIDPPEFTAFFSDLPSNDFNTLFQLLPPLVSNTCMEECLAADGNRSYFVAGVPGSFYRRLFPARTIDFFHSAFSLHWLSQVPESVTDRRSAAYNRGRVFIHGAGEKTTTAYKRQFQADLAEFLRARAAEVKRGGAMFLVCLGRTSVDPTDQGGAGLLFGTHFQDAWDDLVREGLVAAEKRDGFNIPVYAPSLQDFKEVVDANGSFAIDKLVVYKGGSPLVVNEPDDASEVGRAFASSCRSVAGVLVEAHIGEELSNKLFSRVESRATSHAKDVLVNLQFFHIVASLSFT

SEQ ID NO: 6502 - protein, 400 aa, Arabidopsis thaliana
  misc_feature (1)..(400): useful for making plants with modified plant phenotypes as described in USSN 12/139,269
  misc_feature (1)..(400): Public GI no. 50929439
  misc_feature (1)..(400): Utility: Useful for increasing chlorophyll and photosynthetic capacity
  misc_feature (1)..(400): Utility: Useful for making ornamental plants with modified flowers
  misc_feature (1)..(400): Utility: Useful for making ornamental plants with modified leaves
  misc_feature (1)..(400): Utility: Useful for making plants sterile and for genetic confinement
  misc_feature (1)..(400): Utility: Useful for making plants with altered leaf shape eg curled leaves
  misc_feature (1)..(400): Utility: Useful for making plants with increased biomass and foliage
  misc_feature (1)..(400): Utility: Useful for making smaller plants
MASMKGENVTVSAAAAPRMKKLASMLCMKGGNGDGSYLNNSQAQALHARRMLHFLEETLDAMMERSSSDKLFTAADLGCSCGSNSLFIVDVIVRRVSEAYESRGRDAPEFQVFFSDLPSNDFNTLFQLLPPLLAPVAGSLEECLAAGEGAATATRPYHAAGVPGTFYGRLFPGESIDVFTSTFSLHWLSQVPEEVGDSASPAYNGGRVFVHRATEAVAAAYKRQFQADLARFLRSRAREMKRGGAMFLACLGRSSGDPADQGGAGLLFGTHFQDAWDDLVQEGVVEGEKRDSFNIPVYAPSLQEFRDVVRADGAFAIDRLELVRGGSPLVVDRPDDAAEVGRAMANSCKAVAGVLVDAHIGERRGAQLFERLERRAARHARELVEKMHFFHVVCSLSLAP

SEQ ID NO: 6503 - protein, 349 aa, Arabidopsis thaliana
  misc_feature (1)..(349): useful for making plants with modified plant phenotypes as described in USSN 12/139,269
  misc_feature (1)..(349): Public GI no. 54290518
  misc_feature (1)..(349): Utility: Useful for increasing chlorophyll and photosynthetic capacity
  misc_feature (1)..(349): Utility: Useful for making ornamental plants with modified flowers
  misc_feature (1)..(349): Utility: Useful for making ornamental plants with modified leaves
  misc_feature (1)..(349): Utility: Useful for making plants sterile and for genetic confinement
  misc_feature (1)..(349): Utility: Useful for making plants with altered leaf shape eg curled leaves
  misc_feature (1)..(349): Utility: Useful for making plants with increased biomass and foliage
  misc_feature (1)..(349): Utility: Useful for making smaller plants
MMLYALEETLDKIAIPPRGPGRLLLTAADLGCSCGRSSLVVADAIVQHMTKLCRGRGKHVDAVAAADPEFWFYFSDLPSNDFNTLFSLLPPHAASSGDGSGRRYFAAAVPGSFHDRLFPERSIDVFTSTFCLHWLSQVPDEVADTRSPAYNKGKVFVQGSSEETGTAYRRQFQSDMARFLRCRAAELKPGGAMFLVFVGRPSSAGPTDQGRSLNLLGTMFEESWRDLVDEGLIDGGRMDSFNIPSYAATLEEFRESVDADGSFAVNRLEHVMGGRLAVDDDPHDDRCAVGRRVANNQRSIFGPLVEAHIGRALADELFVRMERRAEELSDELVDEMGVRFHILCSLSLV

SEQ ID NO: 6504 - protein, 383 aa, Arabidopsis thaliana
  misc_feature (1)..(383): useful for making plants with modified plant phenotypes as described in USSN 12/139,269
  misc_feature (1)..(383): Public GI no. 50929461
  misc_feature (1)..(383): Utility: Useful for increasing chlorophyll and photosynthetic capacity
  misc_feature (1)..(383): Utility: Useful for making ornamental plants with modified flowers
  misc_feature (1)..(383): Utility: Useful for making ornamental plants with modified leaves
  misc_feature (1)..(383): Utility: Useful for making plants sterile and for genetic confinement
  misc_feature (1)..(383): Utility: Useful for making plants with altered leaf shape eg curled leaves
  misc_feature (1)..(383): Utility: Useful for making plants with increased biomass and foliage
  misc_feature (1)..(383): Utility: Useful for making smaller plants
MKNVFCMKGGQGESSYLKNSKVQFRNLQMMLRALEETLDKVVLPHHGPGRLLLTAADLGCSCGRNTLVVADAIVQHMTKLCRRRGKGEHGDDAAADPEFCFYFSDLPSNDFNTLFGLLPHRGAASSGEGGRGRRHYFAAAVPGSFHDRLFPERSIDVFTSTFCLHWLSQVPEEVADKWSPAYNKEKVFVHGGSEETGAAYRRQFQSDMARFLRCRAAELKPGGAMFLVFLGRPSSAGPTDQGRSLSQFGAMFEESWRDLVGEGLIDGERMDSFNVPSYAATLEEFREVVDADGSFEVNRLELVMGSPLAVDDDDDDSHDRRAVGRTVANNQRSVFGPLVEAHIGKELADELFVRVQSRAEALDDELVDEMRVHIHIVCSLSLV

SEQ ID NO: 6505 - protein, 378 aa, Arabidopsis thaliana
  misc_feature (1)..(378): useful for making plants with modified plant phenotypes as described in USSN 12/139,269
  misc_feature (1)..(378): Public GI no. 50929459
  misc_feature (1)..(378): Utility: Useful for increasing chlorophyll and photosynthetic capacity
  misc_feature (1)..(378): Utility: Useful for making ornamental plants with modified flowers
  misc_feature (1)..(378): Utility: Useful for making ornamental plants with modified leaves
  misc_feature (1)..(378): Utility: Useful for making plants sterile and for genetic confinement
  misc_feature (1)..(378): Utility: Useful for making plants with altered leaf shape eg curled leaves
  misc_feature (1)..(378): Utility: Useful for making plants with increased biomass and foliage
  misc_feature (1)..(378): Utility: Useful for making smaller plants
MQKVLMKDVFCMEGGQGESSYIKNSQVQSRNLQMMLPTLKEILDKVQLPRRPGKHLLTAADLGCSCGHNTLIVADAIVEHMTRKLRSCIFDDQDDGDAADPEFCFYFSDLPSNDFNTLFHLLPQHATAAAGDGSERRYFAAAVPGSFHDRLFPKRSINVFTSTFSLHWLSQVPEGVADKRSAAYNKDKVFVHGASQATGAAYRRQFQSDMARFLRCRATELKAGGVMFLVCLGRPSLHACPTNQGRVQLLYGAMFEESWGDLVEEGTIGRETMGSFNVPVYAATLEEFGEAVGADGLFEINRLELVITSPLAVDDPIRDRRAVANYVRSLLGPLVDAHVGRAVADEIFVRMQRRAEARAEELVDEMRFPHIVCSLSLA

SEQ ID NO: 6506 - protein, 379 aa, Arabidopsis thaliana
  misc_feature (1)..(379): useful for making plants with modified plant phenotypes as described in USSN 12/139,269
  misc_feature (1)..(379): Public GI no. 50929453
  misc_feature (1)..(379): Utility: Useful for increasing chlorophyll and photosynthetic capacity
  misc_feature (1)..(379): Utility: Useful for making ornamental plants with modified flowers
  misc_feature (1)..(379): Utility: Useful for making ornamental plants with modified leaves
  misc_feature (1)..(379): Utility: Useful for making plants sterile and for genetic confinement
  misc_feature (1)..(379): Utility: Useful for making plants with altered leaf shape eg curled leaves
  misc_feature (1)..(379): Utility: Useful for making plants with increased biomass and foliage
  misc_feature (1)..(379): Utility: Useful for making smaller plants
MQEQQQDFKNVFCMEGGQGESSYINNSQSQSRNLKMMLYALEETLDKIQLPRHRPGNKPLLTAADLGCSCGQNTLLIADVIVDHMTDKSFGSKDDDGLEFCFYFSDLPSNDFNTLFHLLPQQAAAAGRDGRQSRRYFAAAVPGSFHDRLFPERSINVFTSTFSLHWLSQVPKRVVDKQSPAYNKGKVFVHGASEETGTAYQRQFRSDMMRFLHCRAAEMKPGGAIFIVSLGRLSSTRGPTEQGYIYEVYCSMFEDSLRDLIEEEMVDGEKMDNFNVPLYAATVEEFKEAVDADGSFKINQLELVMGSPPVVDDPANRGVVGRMVANYMRALFGPLVNTHIGGAMADELFIRMQCRAEIRAEELVDEMCFAHILCSLSLV

SEQ ID NO: 6507 - protein, 380 aa, Arabidopsis thaliana
  misc_feature (1)..(380): useful for making plants with modified plant phenotypes as described in USSN 12/139,269
  misc_feature (1)..(380): Public GI no. 10177828
  misc_feature (1)..(380): Utility: Useful for increasing chlorophyll and photosynthetic capacity
  misc_feature (1)..(380): Utility: Useful for making ornamental plants with modified flowers
  misc_feature (1)..(380): Utility: Useful for making ornamental plants with modified leaves
  misc_feature (1)..(380): Utility: Useful for making plants sterile and for genetic confinement
  misc_feature (1)..(380): Utility: Useful for making plants with altered leaf shape eg curled leaves
  misc_feature (1)..(380): Utility: Useful for making plants with increased biomass and foliage
  misc_feature (1)..(380): Utility: Useful for making smaller plants
MTAKDWTTTSLHRVFAMQGGEDDLSYVNNSDSQALAITLSKPILISSLQSIKLFSDQTPIKITDLGCATGSNTFTTVDTVVETLQRRYTARCGGGGSPEFEAFFCDLPSNDFNMLFKLLAEKQKVDSPAKYFAGGVAGSFYDRLFPRGTIHVAVSLSALHWLSQIPEKVLEKESRTWNKGKTWIEGAKKEVVEAYAEQSDKDLDDFMSCRKEEMVKGGVLFVLMAGRPSGSSSQFGDQDTRAKHPFTTTMEQAWQDLIEEGLIDEETRDGFNIPAYMRSPEEVTAGIDRCGGFKIGKMDFLKIVEYSDEKQEEWKKDPVSYGRARTNLVQAAIRPMVDAYLGPDLSHELFKRYENRVSTNQEFLHITCFYGVVVFSAIRV

SEQ ID NO: 6508 - DNA, 1228 bp, Arabidopsis thaliana
  misc_feature (1)..(1228): useful for making plants with modified plant phenotypes as described in USSN 12/139,269
  misc_feature (1)..(1228): Ceres CLONE ID no. 38105
  misc_feature (1)..(1228): Also known as  Ceres CDNA ID no. 23357010
aaaatttccctatcaaagtgaatgactttcttctccaaaatcgatttctgaaacatcccatttcttgatttccctctttgtcgcaaacccaacaaagtagagcaaaaccctaaaacggaaaccttccatggcgattatctctgaggtagaagaagaaagcagtagcagccgacccatgatatttccctttaggggcaacactcagttctgcaaacccattagggtttttggagaaagttttcgactttctcggagaacagagcgattttctcaagaaaccctccgcggaggacgagatcgtcgtcgcggttagggcggcgaaggagaagttgaaaaaggctgagaagaagaaagctgagaaggagagtgtgaagcctgtggagaagaaagccgagaaggaaattgttaagcttgtggagaagaaggtagagaaggagagtgtcaagccaactatggctgcttcaagtgctgagcctatagaagtggagaagcctaaggacgaagaggagaagaaggaatctggtcccattgttcctaacaaaggtaatggaactgatcttgagaactactcatggatccagaatctccaggaggttacagttaacattccagtgcctactgggactaaagcacggactgttgtatgtgagattaagaaaaaccgtctcaaggttggtctcaaaggccaggatccaatcgtcgatggggagctctaccgatctgtgaagcctgatgactgctactggaatatcgaggatcaaaaggtgatttcgattctcttgactaagtctgatcagatggagtggtggaaatgctgtgtgaaaggtgaacctgaaatcgatactcagaaagttgaaccagagactagtaaattaggtgaccttgatccagaaactcgctcgactgttgagaaaatgatgtttgatcaaaggcaaaagcagatgggtcttccaacaagcgaggagctacagaagcaagagatccttaagaaattcatgtctgagcatccggagatggacttctcaaatgcaaagtttaactgatgctcgtatcgtccagtctctctgccaaaaaagaaaaaccagtttttgcatcttcaccagtttttaaaagcttgttacttttgtttagtttctcatttctgaatacatagttcggtttatgtccctagctttatgattctctggtttttattgaaactttttctgaaaaaaaaactgttttctcc

SEQ ID NO: 6509 - protein, 304 aa, Arabidopsis thaliana
  misc_feature (1)..(304): useful for making plants with modified plant phenotypes as described in USSN 12/139,269
  misc_feature (137)..(288): Pfam Name: Nuclear_move; Pfam Description: Nuclear movement protein
  misc_feature (137)..(288): Pfam Name: Nuclear_move; Pfam Description: Nuclear movement protein
  misc_feature (1)..(304): Utility: Useful for increasing chlorophyll and photosynthetic capacity
  misc_feature (1)..(304): Utility: Useful for making ornamental plants with modified leaves
  misc_feature (1)..(304): Utility: Useful for making smaller plants
MAIISEVEEESSSSRPMIFPFRATLSSANPLGFLEKVFDFLGEQSDFLKKPSAEDEIVVAVRAAKEKLKKAEKKKAEKESVKPVEKKAEKEIVKLVEKKVEKESVKPTMAASSAEPIEVEKPKDEEEKKESGPIVPNKGNGTDLENYSWIQNLQEVTVNIPVPTGTKARTVVCEIKKNRLKVGLKGQDPIVDGELYRSVKPDDCYWNIEDQKVISILLTKSDQMEWWKCCVKGEPEIDTQKVEPETSKLGDLDPETRSTVEKMMFDQRQKQMGLPTSEELQKQEILKKFMSEHPEMDFSNAKFN

SEQ ID NO: 6510 - protein, 161 aa, Triticum aestivum
  misc_feature (1)..(161): useful for making plants with modified plant phenotypes as described in USSN 12/139,269
  misc_feature (1)..(161): Ceres CLONE ID no. 703932
  misc_feature (1)..(161): Utility: Useful for increasing chlorophyll and photosynthetic capacity
  misc_feature (1)..(161): Utility: Useful for making ornamental plants with modified leaves
  misc_feature (1)..(161): Utility: Useful for making smaller plants
MEKYSWTQQLPEVNVNVPVPEGTKSRFVVCEIKKDHLKVGLKGQPPIIDGELHKPVKVDDCFWSIEDGKALSILLTKHNQMEWWKSVIKGDPEVDTQKAEPETSKLSDLDPETRQTVEKMMFDQRQKQMGLPTSDEMQKQDMLKKFMSQHPEMDFSRAKIA

SEQ ID NO: 6511 - protein, 293 aa, Triticum aestivum
  misc_feature (1)..(293): useful for making plants with modified plant phenotypes as described in USSN 12/139,269
  misc_feature (1)..(293): Public GI no. 23296480
  misc_feature (1)..(293): Utility: Useful for increasing chlorophyll and photosynthetic capacity
  misc_feature (1)..(293): Utility: Useful for making ornamental plants with modified leaves
  misc_feature (1)..(293): Utility: Useful for making smaller plants
MAIISEMEEARPSMVPFTASFDPSNPIAFLEKVLDVIGKESNFLKKDTAEKEIVAAVMAAKQRLREAEKKKLEKESVKSMEVEKPKKDSLKPTELEKPKEESLMATDPMEIEKPKEEKESGPIVPNKGNGLDFEKYSWGQNLQEVTINIPMPEGTKSRSVTCEIKKNRLKVGLKGQDLIVDGEFFNSVKPDDCFWNIEDQKMISVLLTKQDQMEWWKYCVKGEPEIDTQKVEPETSKLGDLDPETRASVEKMMFDQRQKQMGLPRSDEIEKKDMLKKFMAQNPGMDFSNAKFN

SEQ ID NO: 6512 - protein, 299 aa, Glycine max
  misc_feature (1)..(299): useful for making plants with modified plant phenotypes as described in USSN 12/139,269
  misc_feature (1)..(299): Ceres CLONE ID no. 474785
  misc_feature (1)..(299): Utility: Useful for increasing chlorophyll and photosynthetic capacity
  misc_feature (1)..(299): Utility: Useful for making ornamental plants with modified leaves
  misc_feature (1)..(299): Utility: Useful for making smaller plants
MAIISDFNEEEPKPAHSSPPQPQSSSSSSSFSATFDRSNPIAFLERVFEFVSEQSDFLATQSAEKEIVSLVHAAGKKKRELLKAERENADKKKREDLKVTEERQKVEKRLNEEKELKAEDTNKNESASRVPNKGNGLDLEKYSWTQSLQEVNVNVPVPNGTKSRFVTVEIKKNHLKVGLKGQPPIIEGEFHKSVKPDDCYWSIEDQNSISILLTKHDQMEWWKCLVKGDPEIDTQKVEPENSKLGDLDPETRQTVEKMMFDQRQKSMGLPTSEELQKQEMLKKFMSEHPEMDFSRAKIS

SEQ ID NO: 6513 - protein, 295 aa, Glycine max
  misc_feature (1)..(295): useful for making plants with modified plant phenotypes as described in USSN 12/139,269
  misc_feature (1)..(295): Public GI no. 30524691
  misc_feature (1)..(295): Utility: Useful for increasing chlorophyll and photosynthetic capacity
  misc_feature (1)..(295): Utility: Useful for making ornamental plants with modified leaves
  misc_feature (1)..(295): Utility: Useful for making smaller plants
MAILSDYEEEEHQPQPEKKQPSKKFSATFDPSNPLGFLQSTLEFVSKESDFFAKESSAKDVVSLVQKVKEKYIEEVENKKKKLLDESAAAAAAAAAAAASSSSSDLEKKVDDNESAEETEKSKYKAPNSGNGQDLENYSWIQSLQEVTVNVPVPPGTKSRFIDCQIKKNHLKVGLKGQPPIIDGELFKPVKPDDCFWSLEDQKSISMLLTKHDQMEWWRSLVKGEPEIDTQKVEPESSKLSDLDPETRSTVEKMMFDQRQKSMGLPTSDDMQKQDMLKKFMSEHPEMDFSNAKFN

SEQ ID NO: 6514 - protein, 308 aa, Glycine max
  misc_feature (1)..(308): useful for making plants with modified plant phenotypes as described in USSN 12/139,269
  misc_feature (1)..(308): Public GI no. 51535412
  misc_feature (1)..(308): Utility: Useful for increasing chlorophyll and photosynthetic capacity
  misc_feature (1)..(308): Utility: Useful for making ornamental plants with modified leaves
  misc_feature (1)..(308): Utility: Useful for making smaller plants
MAIISDFQEEEAPPRQQQQPASVAAAAGSGDEVLAAELERRGGAIPFLQAAIDVARRRSDLFRDPSAVSRVTSMASAARAVVEAEERKAREAKRKAEEAERKAAEAERKAKAPAEPKPESSAGKDSMEVDKKEEGNVRKPNAGNGLDLEKYSWIQQLPEVTITVPVPQGTKSRFVVCDIKKNHLKVGLKGQPPIIDGELFKPVKVDDCFWSIEDGKSLSILLTKQNQMEWWKSVVKGDPEVDTQKVEPENSKLADLDPETRQTVEKMMFDQRQKQMGLPTSDEMQKQDMLKKFMAQHPEMDFSNAKIA

SEQ ID NO: 6515 - DNA, 1606 bp, Arabidopsis thaliana
  misc_feature (1)..(1606): useful for making plants with modified plant phenotypes as described in USSN 12/139,269
  misc_feature (1)..(1606): Ceres CLONE ID no. 38214
  misc_feature (1)..(1606): Also known as  Ceres CDNA ID no. 23373803
aaaaacaaataatatctaacaaaaaaccattcacaaaaaaaatagagagaatcatctgagagactagtagtgatgagatgagcttcttctcctacaatctcagaaacctccgatcactgttttagataatctctacaacggatacaatggaaagcaccgattcttccggtggtccaccaccgccacaacctaaccttcctccaggcttccggtttcaccctaccgacgaagagcttgttgttcactacctcaaacgcaaagcagcctctgctcctttacctgtcgccatcatcgccgaagtcgatctctataaatttgatccatgggaacttcccgctaaagcatcgtttggagaacaagaatggtacttctttagtccacgagatcggaagtatccaaacggagcaagaccaaacagagcggcgacttcaggttattggaaagcgaccggtacagataaaccggtacttgcttccgacggtaaccaaaaggtgggcgtgaagaaggcactagtcttctacagtggtaaaccaccaaaaggcgttaaaagtgattggatcatgcatgagtatcgtctcatcgaaaacaaaccaaacaatcgacctcctggctgtgatttcggcaacaagaaaaactcactcagacttgatgattgggtgttatgtagaatctacaagaagaacaacgcaagtcgacatgttgataacgataaggatcatgatatgatcgattacattttcaggaagattcctccatctttatcaatggcggctgcttctacaggacttcaccatcatcatcataatgtctcaagatcaatgaatttcttccctggcaaattctccggtggtggttacgggattttctctgacggtggtaacacgagtatatacgacggcggtggcatgatcaacaatattggtactgactcagtggatcacgacaataacgcagacgtcgttggtttaaatcatgcttcgtcgtctggtcctatgatgatggcgaatttgaaacgaactctcccggtgccgtattggcctgtagcagaggaggagcaagatgcatctccgagcaaacggtttcacggtgtaggaggaggaggaggagattgttcgaacatgtcttcttcgatgatggaagagacacctccactaatgcaacaacaaggtggtgtattaggagatggattattcagaacgacatcgtaccaattacccggtttaaattggtactcttcttaatcaaatgtgtttcgccgccggtgtgaagaattttccggtgacagtgaagattttttccgattggtggggtcatttgcatgcattatataatttgagatttgtgtatatgttttgggttaattaattggtcataggggttaggggaagaagattatttagagagcggagaagatcagaagtgaggcaacatatagaaaacataggtttaaaaaatattactgtttgttaagtttaatgattaaatgtataaatcttatacttagatgtttatatatagtttgtatagatgcatatagtttctctcaatgctattttgagattgtattttcttgttaaggaaatgattaaaaaaaaaatagttgtgc

SEQ ID NO: 6516 - protein, 364 aa, Arabidopsis thaliana
  misc_feature (1)..(364): useful for making plants with modified plant phenotypes as described in USSN 12/139,269
  misc_feature (17)..(145): Pfam Name: NAM; Pfam Description: No apical meristem (NAM) protein
  misc_feature (17)..(145): Pfam Name: NAM; Pfam Description: No apical meristem (NAM) protein
  misc_feature (1)..(364): Utility: Useful for increasing chlorophyll and photosynthetic capacity
  misc_feature (1)..(364): Utility: Useful for making ornamental plants with modified flowers
  misc_feature (1)..(364): Utility: Useful for making plants sterile and for genetic confinement
  misc_feature (1)..(364): Utility: Useful for making plants with increased biomass and foliage
  misc_feature (1)..(364): Utility: Useful for making smaller plants
MESTDSSGGPPPPQPNLPPGFRFHPTDEELVVHYLKRKAASAPLPVAIIAEVDLYKFDPWELPAKASFGEQEWYFFSPRDRKYPNGARPNRAATSGYWKATGTDKPVLASDGNQKVGVKKALVFYSGKPPKGVKSDWIMHEYRLIENKPNNRPPGCDFGNKKNSLRLDDWVLCRIYKKNNASRHVDNDKDHDMIDYIFRKIPPSLSMAAASTGLHHHHHNVSRSMNFFPGKFSGGGYGIFSDGGNTSIYDGGGMINNIGTDSVDHDNNADVVGLNHASSSGPMMMANLKRTLPVPYWPVAEEEQDASPSKRFHGVGGGGGDCSNMSSSMMEETPPLMQQQGGVLGDGLFRTTSYQLPGLNWYSS

SEQ ID NO: 6517 - protein, 318 aa, Arabidopsis thaliana
  misc_feature (1)..(318): useful for making plants with modified plant phenotypes as described in USSN 12/139,269
  misc_feature (1)..(318): Public GI no. 62530909
  misc_feature (1)..(318): Utility: Useful for increasing chlorophyll and photosynthetic capacity
  misc_feature (1)..(318): Utility: Useful for making ornamental plants with modified flowers
  misc_feature (1)..(318): Utility: Useful for making plants sterile and for genetic confinement
  misc_feature (1)..(318): Utility: Useful for making plants with increased biomass and foliage
  misc_feature (1)..(318): Utility: Useful for making smaller plants
MEMAAAVGGSGRRDAEAELNLPPGFRFHPTDEELVVHYLCRKVARQPLPVPIIAEVDLYKLDPWDLPEKALFGRKEWYFFTPRDRKYPNGSRPNRAAGRGYWKATGADKPVAPKGSARTVGIKKALVFYSGKAPRGVKTDWIMHEYRLADADRAPGGKKGSQKLDEWVLCRLYNKKNNWEKVKLEQQDVASVAAAAPRNHHHQNGEVMDAAAADTMSDSFQTHDSDIDNASAGLRHGGCGGGGFGDVAPPRNGFVTVKEDNDWFTGLNFDELQPPYMMNLQHMQMQMVNPAAPGHDGGYLQSISSPQMKMWQTILPPF

SEQ ID NO: 6518 - protein, 316 aa, Arabidopsis thaliana
  misc_feature (1)..(316): useful for making plants with modified plant phenotypes as described in USSN 12/139,269
  misc_feature (1)..(316): Public GI no. 56785066
  misc_feature (1)..(316): Utility: Useful for increasing chlorophyll and photosynthetic capacity
  misc_feature (1)..(316): Utility: Useful for making ornamental plants with modified flowers
  misc_feature (1)..(316): Utility: Useful for making plants sterile and for genetic confinement
  misc_feature (1)..(316): Utility: Useful for making plants with increased biomass and foliage
  misc_feature (1)..(316): Utility: Useful for making smaller plants
MAAAVGGSGRRDAEAELNLPPGFRFHPTDEELVVHYLCRKVARQPLPVPIIAEVDLYKLDPWDLPEKALFGRKEWYFFTPRDRKYPNGSRPNRAAGRGYWKATGADKPVAPKGSARTVGIKKALVFYSGKAPRGVKTDWIMHEYRLADADRAPGGKKGSQKLDEWVLCRLYNKKNNWEKVKLEQQDVASVAAAAPRNHHHQNGEVMDAAAADTMSDSFQTHDSDIDNASAGLRHGGCGGGGFGDVAPPRNGFVTVKEDNDWFTGLNFDELQPPYMMNLQHMQMQMVNPAAPGHDGGYLQSISSPQMKMWQTILPPF

SEQ ID NO: 6519 - protein, 306 aa, Zea mays
  misc_feature (1)..(306): useful for making plants with modified plant phenotypes as described in USSN 12/139,269
  misc_feature (1)..(306): Ceres CLONE ID no. 1452029
  misc_feature (1)..(306): Utility: Useful for increasing chlorophyll and photosynthetic capacity
  misc_feature (1)..(306): Utility: Useful for making ornamental plants with modified flowers
  misc_feature (1)..(306): Utility: Useful for making plants sterile and for genetic confinement
  misc_feature (1)..(306): Utility: Useful for making plants with increased biomass and foliage
  misc_feature (1)..(306): Utility: Useful for making smaller plants
MVASQGGGRRDAEAELNLPPGFRFHPTDEELVVHYLCRKVACQQLPVPIIAEVDLYKFDPWDLPEKALFGRKEWYFFTPRDRKYPNGSRPNRAAGRGYWKATGADKPIAPKGGGGAAGIKKALVFYSGKAPRGFKTDWIMHEYRLADADRAPGKKGSRKLDEWVLCRLYNKKNNWEKVKAEEPEAAAPLRNQQGAAEDSMSDSFQTHDSDIDNNAFGVQNGFGNMVHGQAMTMRNGIGSVARTVKEDSYWFTDLNLDDLQAPYNVTHVLNPNPVQTMNLAAGQGHGYLQSMSSPSTKMWQTILPPF

SEQ ID NO: 6520 - protein, 285 aa, Brassica napus
  misc_feature (1)..(285): useful for making plants with modified plant phenotypes as described in USSN 12/139,269
  misc_feature (1)..(285): Ceres CLONE ID no. 1114366
  misc_feature (1)..(285): Utility: Useful for increasing chlorophyll and photosynthetic capacity
  misc_feature (1)..(285): Utility: Useful for making ornamental plants with modified flowers
  misc_feature (1)..(285): Utility: Useful for making plants sterile and for genetic confinement
  misc_feature (1)..(285): Utility: Useful for making plants with increased biomass and foliage
  misc_feature (1)..(285): Utility: Useful for making smaller plants
MSELQLPPGFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSSAARKKKNSLRLDDWVLCRIYNKKGAIEKRGPPPTPVVYGDEVVEEKPRLSEMGMPPPPVMPNDFVYFDTSDSVPKLHTTESSCSEQVVSPEFTSEVQSEPKWKDWSGEKSSLDFGFNYIDATAFGGGGGSNQLFPLQDMFMYNMPKPY

SEQ ID NO: 6521 - protein, 281 aa, Brassica napus
  misc_feature (1)..(281): useful for making plants with modified plant phenotypes as described in USSN 12/139,269
  misc_feature (1)..(281): Public GI no. 53749460
  misc_feature (1)..(281): Utility: Useful for increasing chlorophyll and photosynthetic capacity
  misc_feature (1)..(281): Utility: Useful for making ornamental plants with modified flowers
  misc_feature (1)..(281): Utility: Useful for making plants sterile and for genetic confinement
  misc_feature (1)..(281): Utility: Useful for making plants with increased biomass and foliage
  misc_feature (1)..(281): Utility: Useful for making smaller plants
MVGKISSDLPPGFRFHPTDEELIMYYLRYQATSRPCPVSIIPEIDVYKFDPWELPEKAEFGENEWYFFTPRDRKYPNGVRPNRAAVSGYWKATGTDKAIYSANKYVGIKKALVFYKGKPPKGVKTDWIMHEYRLSDSKSQTYSKQSGSMRLDDWVLCRIYKKKNLGKTIEMMKVEEEELEAQNVSINNAIEVGGPQTMKLPRICSLSHLLELDYFGSIPQLLSDNLLYDDQSYTMNNVSNTSNVDQVSSQQQNTNNITSNNCNIFFNYQQPLFVNPTFQSQ

SEQ ID NO: 6522 - protein, 354 aa, Brassica napus
  misc_feature (1)..(354): useful for making plants with modified plant phenotypes as described in USSN 12/139,269
  misc_feature (1)..(354): Public GI no. 51702424
  misc_feature (1)..(354): Utility: Useful for increasing chlorophyll and photosynthetic capacity
  misc_feature (1)..(354): Utility: Useful for making ornamental plants with modified flowers
  misc_feature (1)..(354): Utility: Useful for making plants sterile and for genetic confinement
  misc_feature (1)..(354): Utility: Useful for making plants with increased biomass and foliage
  misc_feature (1)..(354): Utility: Useful for making smaller plants
MPMGSSAAMPALPPGFRFHPTDEELIVHYLRRQAASMPSPVPIIAEVNIYKCNPWDLPGKALFGENEWYFFSPRDRKYPNGARPNRAAGSGYWKATGTDKAILSTPANESIGVKKALVFYRGKPPKGVKTDWIMHEYRLTAADNRTTKRRGSSMRLDDWVLCRIHKKCGNLPNFSSSDQEQEHEQESSTVEDSQNNHTVSSPKSEAFDGDGDDHLQLQQFRPMAIAKSCSLTDLLNTVDYAALSHLLLDGAGASSSDAGADYQLPPENPLIYSQPPWQQTLHYNNNNGYVNNETIDVPQLPEARVDDYGMNGDKYNGMKRKRSSGSLYCSQLQLPADQYSGMLIHPFLSQQLHM

SEQ ID NO: 6523 - protein, 355 aa, Brassica napus
  misc_feature (1)..(355): useful for making plants with modified plant phenotypes as described in USSN 12/139,269
  misc_feature (1)..(355): Public GI no. 52353038
  misc_feature (1)..(355): Utility: Useful for increasing chlorophyll and photosynthetic capacity
  misc_feature (1)..(355): Utility: Useful for making ornamental plants with modified flowers
  misc_feature (1)..(355): Utility: Useful for making plants sterile and for genetic confinement
  misc_feature (1)..(355): Utility: Useful for making plants with increased biomass and foliage
  misc_feature (1)..(355): Utility: Useful for making smaller plants
MESTDSSTGTRHQPQLPPGFRFHPTDEELIVHYLKKRVAGAPIPVDIIGEIDLYKFDPWELPAKAIFGEQEWFFFSPRDRKYPNGARPNRAATSGYWKATGTDKPVFTSGGTQKVGVKKALVFYGGKPPKGVKTNWIMHEYRVVENKTNNKPLGCDNIVANKKGSLRLDDWVLCRIYKKNNTQRSIDDLHDMLGSIPQNVPNSILQGIKPSNYGTILLENESNMYDGIMNNTNDIINNNNRSIPQISSKRTMHGGLYWNNDEATTTTTTIDRNHSPNTKRFLVENNEDDGLNMNNISRITNHEQSSSIANFLSQFPQNPSIQQQQQQQEEVLGSLNDGVVFRQPYNQVTGMNWYS

SEQ ID NO: 6524 - protein, 362 aa, Glycine max
  misc_feature (1)..(362): useful for making plants with modified plant phenotypes as described in USSN 12/139,269
  misc_feature (1)..(362): Ceres CLONE ID no. 533917
  misc_feature (1)..(362): Utility: Useful for increasing chlorophyll and photosynthetic capacity
  misc_feature (1)..(362): Utility: Useful for making ornamental plants with modified flowers
  misc_feature (1)..(362): Utility: Useful for making plants sterile and for genetic confinement
  misc_feature (1)..(362): Utility: Useful for making plants with increased biomass and foliage
  misc_feature (1)..(362): Utility: Useful for making smaller plants
MDSRDSSSGSQHPHLPPGFRFHPTDEELVVHYLKRKAASAPLPVAIIADVDLYKFDPWELPSKATFGEQEWYFFSPRDRKYPNGARPNRAATSGYWKATGTDKPILTTYGHHKVGVKKALVFYGGKPPKGVKTNWIMHEYRLVDDSFNSSSKPPPLVPHNKKNSLRLDDWVLCRIYKKSNNTTLPRPPMMEHEEELSMDNMLPTMSTLSMANNKMQNPKPPSRSTSYGPLGLENDDNFFEGVLAVDQSMQNGSDSHIFSPNSKGDNNNNNNNNASNFPIKRALITSQLWNETGSPGSSSSCKRFHGDLNCGCSNAEDNNDSFISLLSQFPQNATFQPNAIHGSVEDDGAPRQQFHLHGINWN

SEQ ID NO: 6525 - DNA, 1361 bp, Arabidopsis thaliana
  misc_feature (1)..(1361): useful for making plants with modified plant phenotypes as described in USSN 12/139,269
  misc_feature (1)..(1361): Ceres CLONE ID no. 41320
  misc_feature (1)..(1361): Also known as  Ceres CDNA ID no. 23370232
  misc_feature (993)..(993): y is t/u or c
cccattttctctcttttacttgttcgttcccaaactcttctccctcgatcgtctccgtcgccgatctcgtttcttcattttccgcgtgttgattggtacaaaggtttaatcaaatggttggaggaggagttatccagcaaattcttaggaggaagcttcactcccaatcacttgcaactccggttttgtcttggttttcttcgaagaaagctcatgaggatgctggttcttctggtgtaagagcacttgccttgttgggtgctggtgtttcaggactgttgagtttttctacagtagcatctgctgatgaggctgaacatggattggagagtccagagtacccttggcctcatgatggcattcttagctcatatgaccatgcttcgatccgtcgtgggcatcaagtttatcagcaagtctgtgcatcatgccattcaatgtctctgatctcataccgagacttggtgggtgtcgcctacacagaggaagaggcaaaggcaatggcagctgaaatcgaggtagtagatggacctaatgatgagggtgagatgttcacccgccctggtaaactcagtgaccggtttcctcagccatatgcaaatgaatcagctgcaaggtttgctaatggtggagcgtatcctcctgatctaagtcttatcactaaggcacgtcacaatggtccaaactatgtctttgcgcttctgactggttaccgtgatccccctgctggcatatcgattagagaggggttacactacaatccttatttccctgggggagcaattgctatgccgaaaatgctcaatgatgaagctgttgagtatgaagatggtgtccccgccacagaggcacagatgggtaaagatattgtatcattcttggcctgggcagctgaaccagaaatggaagagaggaaactgatgggtttcaaatggatattcctactctctctcgctcttctccaagctgcttactacaggcgactgaaatggycggttctcaagtcccgcaagctggttcttgacgtggttaactaaagcgccgctgaaaagcttttgcattggcctggccacacacagtcgtattttcaacaaaggatgttaaatagagaagagcctttctctgggtaataacgtatcatcatttttatgtgtcataaaaatctttgatgagaccagttctcacctgaaggtgaaaagacctcatcgttcttctttttccttcgattattactagagagttttatgaggataatcacgaaaacttgtttttttcgcctcataataatcacacatgattttgagattatatcatttgttatgtttttcctcttgtctcaataaaaaataactttgtactcc

SEQ ID NO: 6526 - protein, 307 aa, Arabidopsis thaliana
  misc_feature (1)..(307): useful for making plants with modified plant phenotypes as described in USSN 12/139,269
  misc_feature (72)..(297): Pfam Name: Cytochrom_C1; Pfam Description: Cytochrome C1 family
  misc_feature (72)..(297): Pfam Name: Cytochrom_C1; Pfam Description: Cytochrome C1 family
  misc_feature (1)..(307): Utility: Useful for increasing chlorophyll and photosynthetic capacity
  misc_feature (1)..(307): Utility: Useful for making plants sterile and for genetic confinement
  misc_feature (1)..(307): Utility: Useful for making smaller plants
MVGGGVIQQILRRKLHSQSLATPVLSWFSSKKAHEDAGSSGVRALALLGAGVSGLLSFSTVASADEAEHGLESPEYPWPHDGILSSYDHASIRRGHQVYQQVCASCHSMSLISYRDLVGVAYTEEEAKAMAAEIEVVDGPNDEGEMFTRPGKLSDRFPQPYANESAARFANGGAYPPDLSLITKARHNGPNYVFALLTGYRDPPAGISIREGLHYNPYFPGGAIAMPKMLNDEAVEYEDGVPATEAQMGKDIVSFLAWAAEPEMEERKLMGFKWIFLLSLALLQAAYYRRLKWSVLKSRKLVLDVVN

SEQ ID NO: 6527 - protein, 224 aa, Zea mays
  misc_feature (1)..(224): useful for making plants with modified plant phenotypes as described in USSN 12/139,269
  misc_feature (1)..(224): Ceres CLONE ID no. 399596
  misc_feature (1)..(224): Utility: Useful for increasing chlorophyll and photosynthetic capacity
  misc_feature (1)..(224): Utility: Useful for making plants sterile and for genetic confinement
  misc_feature (1)..(224): Utility: Useful for making smaller plants
MSSYDHASIRRGHQVYTQVCASCHSMSLISYRDLVGVAYTEEETKAMAAEIEVVDGPNDEGEMFTRPGKLSDRFPQPYANEQAARFANGGAYPPDLSLITKARHNGQNYVFALLTGYHDPPAGVQIREGLHYNPYFPGGAIAMPKMLNDGAVEYEDGTPATEAQMGKDVVSFLSWAAEPEMEERKLMGVKWIFLLSLALLQAAYYRRMRWSVLKSRKLVLDVVN

SEQ ID NO: 6528 - protein, 307 aa, Arabidopsis thaliana
  misc_feature (1)..(307): useful for making plants with modified plant phenotypes as described in USSN 12/139,269
  misc_feature (1)..(307): Ceres CLONE ID no. 112937
  misc_feature (1)..(307): Utility: Useful for increasing chlorophyll and photosynthetic capacity
  misc_feature (1)..(307): Utility: Useful for making plants sterile and for genetic confinement
  misc_feature (1)..(307): Utility: Useful for making smaller plants
MVGGGVIRQLLRRKLHSQSVATPVLSWLSSKKANEDAGSAGLRAFALMGAGITGLLSFSTVASADEAEHGLECPNYPWPHEGILSSYDHASIRRGHQVYQQVCASCHSMSLISYRDLVGVAYTEEEAKAMAAEIEVVDGPNDEGEMFTRPGKLSDRLPEPYSNESAARFANGGAYPPDLSLVTKARHNGQNYVFALLTGYRDPPAGISIREGLHYNPYFPGGAIAMPKMLNDEAVEYEDGTPATEAQMGKDVVSFLSWAAEPEMEERKLMGFKWIFLLSLALLQAAYYRRLKWSVLKSRKLVLDVVN

SEQ ID NO: 6529 - protein, 307 aa, Arabidopsis thaliana; identical to SEQ ID NO: 6528
  misc_feature (1)..(307): useful for making plants with modified plant phenotypes as described in USSN 12/139,269
  misc_feature (1)..(307): Ceres CLONE ID no. 30054
  misc_feature (1)..(307): Utility: Useful for increasing chlorophyll and photosynthetic capacity
  misc_feature (1)..(307): Utility: Useful for making plants sterile and for genetic confinement
  misc_feature (1)..(307): Utility: Useful for making smaller plants

SEQ ID NO: 6530 - protein, 307 aa, Glycine max
  misc_feature (1)..(307): useful for making plants with modified plant phenotypes as described in USSN 12/139,269
  misc_feature (1)..(307): Ceres CLONE ID no. 621235
  misc_feature (1)..(307): Utility: Useful for increasing chlorophyll and photosynthetic capacity
  misc_feature (1)..(307): Utility: Useful for making plants sterile and for genetic confinement
  misc_feature (1)..(307): Utility: Useful for making smaller plants
MAGGVIQQILRRKLHPRFTNSPLLSPIVAKKDDAGSTGSQSLRALALIGAGLSGLFSFSTMAAADEAEHGLACPSYPWPHKGILSSYDHASIRRGHQVYTEVCASCHSMSLISYRDLVGVAYTEEEVKAMAAEIEVVDGPNDEGEMFTRPGKLSDRFPQPYANEAAARFANGGAYPPDLSLVTKARHNGQNYVFALLTGYRDPPAGVSIREGLHYNPYFPGGAIAMPKMLNDGAVEYEDGTPATEAQMGKDVVSFLTWAAEPEMEERKLMGFKWIFVLSLALLQAAYYRRLRWSVLKSRKLVLDVVN

SEQ ID NO: 6531 - protein, 307 aa, Glycine max; identical to SEQ ID NO: 6530
  misc_feature (1)..(307): useful for making plants with modified plant phenotypes as described in USSN 12/139,269
  misc_feature (1)..(307): Ceres CLONE ID no. 516928
  misc_feature (1)..(307): Utility: Useful for increasing chlorophyll and photosynthetic capacity
  misc_feature (1)..(307): Utility: Useful for making plants sterile and for genetic confinement
  misc_feature (1)..(307): Utility: Useful for making smaller plants

SEQ ID NO: 6532 - protein, 304 aa, Zea mays
  misc_feature (1)..(304): useful for making plants with modified plant phenotypes as described in USSN 12/139,269
  misc_feature (1)..(304): Ceres CLONE ID no. 1556600
  misc_feature (1)..(304): Utility: Useful for increasing chlorophyll and photosynthetic capacity
  misc_feature (1)..(304): Utility: Useful for making plants sterile and for genetic confinement
  misc_feature (1)..(304): Utility: Useful for making smaller plants
MAAARGINQLLKRILHNQSAGPWLLSSFRGNHEESSAGLRALALLGVGASGLLSFATIASADEAEHGLAAPDYPWPHAGIMSSYDHASIRRGHQVYTQVCASCHSMSLISYRDLVGVAYTEEETKAMAAEIEVVDGPNDEGEMFTRPGKLSDRFPQPYANEQAARFANGGAYPPDLSLITKARHNGQNYVFALLTGYRDPPAGVQIREGLHYNPYFPGGAIAMPKMLNDGAVEYEDGTPATEAQMGKDVVSFLSWAAEPEMEERKLMGVKWIFLLSLALLQAAYYRRMRWSVLKSRKLVLDVVN

SEQ ID NO: 6533 - protein, 304 aa, Zea mays
  misc_feature (1)..(304): useful for making plants with modified plant phenotypes as described in USSN 12/139,269
  misc_feature (1)..(304): Ceres CLONE ID no. 287422
  misc_feature (1)..(304): Utility: Useful for increasing chlorophyll and photosynthetic capacity
  misc_feature (1)..(304): Utility: Useful for making plants sterile and for genetic confinement
  misc_feature (1)..(304): Utility: Useful for making smaller plants
MAAARGINQLLKRTLYNQSVGSSPLFSFRGKHEESSAGLRALALLGVGASGLLSFATIASADEAEHGLAAPDYPWPHAGIMSSYDHASIRRGHQVYTQVCASCHSMSLISYRDLVGVAYTEEETKAMAAEIEVVDGPNDEGEMFTRPGKLSDRFPQPYANEQAARFANGGAYPPDLSLITKARHNAQNYVFALLTGYHDPPAGVQIREGLHYNPYFPGGAIAMPKMLNDGAVEYEDGTPATEAQMGKDVVSFPSWAAEPEMEERKLMGVKWIFLLSLALLQAAYYRRMRWSVLKSRKLVLDVVN

SEQ ID NO: 6534 - protein, 134 aa, Glycine max
  misc_feature (1)..(134): useful for making plants with modified plant phenotypes as described in USSN 12/139,269
  misc_feature (1)..(134): Ceres CLONE ID no. 1245439
  misc_feature (1)..(134): Utility: Useful for increasing chlorophyll and photosynthetic capacity
  misc_feature (1)..(134): Utility: Useful for making plants sterile and for genetic confinement
  misc_feature (1)..(134): Utility: Useful for making smaller plants
  misc_feature (103)..(103): Xaa is any aa, unknown or other
  misc_feature (110)..(110): Xaa is any aa, unknown or other
  misc_feature (115)..(115): Xaa is any aa, unknown or other
  misc_feature (125)..(125): Xaa is any aa, unknown or other
MAGGVIQQILRRKLHPRFTNSPLLSPIVAKKDDAGSTGSQSLRALALIGAGLSGLFSFSTMAAADEAEHGLACPSYPWPHKGILSSYDHASIRRGHQVYTEVXASWHSMXLISYXDLGGGWLIQXKKERLWQLK

SEQ ID NO: 6535 - DNA, 1077 bp, Arabidopsis thaliana
  misc_feature (1)..(1077): useful for making plants with modified plant phenotypes as described in USSN 12/139,269
  misc_feature (1)..(1077): Ceres CLONE ID no. 42533
  misc_feature (1)..(1077): Also known as  Ceres CDNA ID no. 23357962
atcttctatctctcaaaagaaaagcagacaactttatttgcaaaacagagtttttttttcttttcttgagaaagttcaacagaagatgatgttggagaaagacgatctgggtctaagcttaggcttgaattttccaaagaaacagatcaatctcaaatcaaatccatctgtttctgttactccttcttcttcttcttttggattattcagaagatcttcatggaacgagagttttacttcttcagttccaaactcagattcgtcacaaaaagaaacaagaactttcatccgaggaatcgacgtgaacagaccaccgtctacagcggaatacggcgacgaagacgctggagtatcttcacctaacagtacaatctcaagctctacagggaaaagaagcgagagagaagaagacacagatccacaaggctcaagaggaatcagtgacgatgaagatggtgataactccaggaaaaagcttagactttccaaagatcaatctgctattcttgaagagaccttcaaagatcacagtactctcaatccgaagcagaagcaagcattggctaaacaattagggttaagagcaagacaagtggaagtttggtttcagaacagacgagcaagaacaaagctgaagcaaacggaggtagactgtgagttcttacggagatgctgcgagaatctaacggaagaaaaccgtcggctacaaaaagaagtaacggagttgagagcacttaagctctctcctcagttctacatgcacatgagcccacccactactttgaccatgtgcccttcatgtgaacacgtgtcggtcccgccaccacaacctcaggctgctacgtcagcacaccaccggacgttgccggtcaatgcgtgggctcctgcgacgaggatatctcacggcttgacttttgacgctcttcgtcctaggtcctaagtctttttacttacaatcaaagggcattgtggtcgttttattaagtttcagggaccagatatgcatgtagttgttaacatgtatgtattttttttagaaagaaagaaaaacagattaatatttttctagcttaaatc

SEQ ID NO: 6536 - protein, 284 aa, Arabidopsis thaliana
  misc_feature (1)..(284): useful for making plants with modified plant phenotypes as described in USSN 12/139,269
  misc_feature (1)..(109): Pfam Name: HD-ZIP_N; Pfam Description: HD-ZIP protein N terminus
  misc_feature (129)..(183): Pfam Name: Homeobox; Pfam Description: Homeobox domain
  misc_feature (184)..(228): Pfam Name: HALZ; Pfam Description: Homeobox associated leucine zipper
  misc_feature (1)..(284): Utility: Useful for increasing chlorophyll and photosynthetic capacity
  misc_feature (1)..(284): Utility: Useful for making plants with increased biomass and foliage
MMFEKDDLGLSLGLNFPKKQINLKSNPSVSVTPSSSSFGLFRRSSWNESFTSSVPNSDSSQKETRTFIRGIDVNRPPSTAEYGDEDAGVSSPNSTVSSSTGKRSEREEDTDPQGSRGISDDEDGDNSRKKLRLSKDQSAILEETFKDHSTLNPKQKQALAKQLGLRARQVEVWFQNRRARTKLKQTEVDCEFLRRCCENLTEENRRLQKEVTELRALKLSPQFYMHMSPPTTLTMCPSCEHVSVPPPQPQAATSAHHRSLPVNAWAPATRISHGLTFDALRPRS

SEQ ID NO: 6537 - protein, 289 aa, Arabidopsis thaliana; identical to SEQ ID NO: 5701
  misc_feature (1)..(289): useful for making plants with modified plant phenotypes as described in USSN 12/139,269
  misc_feature (1)..(289): Public GI no. 8919876
  misc_feature (1)..(289): Utility: Useful for increasing chlorophyll and photosynthetic capacity
  misc_feature (1)..(289): Utility: Useful for making plants with increased biomass and foliage

SEQ ID NO: 6538 - protein, 284 aa, Glycine max
  misc_feature (1)..(284): useful for making plants with modified plant phenotypes as described in USSN 12/139,269
  misc_feature (1)..(284): Ceres CLONE ID no. 1044452
  misc_feature (1)..(284): Utility: Useful for increasing chlorophyll and photosynthetic capacity
  misc_feature (1)..(284): Utility: Useful for making plants with increased biomass and foliage
  misc_feature (72)..(72): Xaa is any aa, unknown or other
MTVQKEDLGLSLSLSFPLLSSSPSSHNPQKPSWNDPIFTSSGEAGSFLRGIDVNRLPSVVDCEEEAGVSSPXSTVSSVSGKRSERETNGEENDTDRACSRGIISDEEDAETSRKKLRLSKDQSIVLEESFKEHNTLNPKQKLALAKQLGLRARQVEVWFQNRRARTKLKQTEVDCEFLKRCCENLTEENRRLQKEVQELRALKLSPQFYMHMTPPTTLTMCPSCERVAFPPPLPLILPRVTITCLHLTPGPFPLAHGQALRCPPSQILDSRKQNDKIEKKDRKP

SEQ ID NO: 6539 - protein, 284 aa, Glycine max
  misc_feature (1)..(284): useful for making plants with modified plant phenotypes as described in USSN 12/139,269
  misc_feature (1)..(284): Public GI no. 1234900
  misc_feature (1)..(284): Utility: Useful for increasing chlorophyll and photosynthetic capacity
  misc_feature (1)..(284): Utility: Useful for making plants with increased biomass and foliage
MTVQKEDLGLSLSLSFPLLSSSPSSHNPQKPSWNDPIFTSSGEAGSFLRGIDVNRLPSVVDCEEEAGVSSPNSTVSSVSGKRSERETNGEENDTDRACSRGIISDEEDAETSRKKLRLSKDQSIVLEESFKEHNTLNPKQKLALAKQLGLRARQVEVWFQNRRARTKLKQTEVDCEFLKRCCENLTEENRRLQKEVQELRALKLSPQFYMHMTPPTTLTMCPSCERVAVPPSSAVDPATRHHHVPPSHPRAFPIGHGQALRCPPSQILDSRKQNDKIEKKDRKP

SEQ ID NO: 6540 - protein, 285 aa, Glycine max; identical to SEQ ID NO: 5700
  misc_feature (1)..(285): useful for making plants with modified plant phenotypes as described in USSN 12/139,269
  misc_feature (1)..(285): Ceres CLONE ID no. 514259
  misc_feature (1)..(285): Utility: Useful for increasing chlorophyll and photosynthetic capacity
  misc_feature (1)..(285): Utility: Useful for making plants with increased biomass and foliage

SEQ ID NO: 6541 - protein, 297 aa, Glycine max; identical to SEQ ID NO: 5699
  misc_feature (1)..(297): useful for making plants with modified plant phenotypes as described in USSN 12/139,269
  misc_feature (1)..(297): Ceres CLONE ID no. 527278
  misc_feature (1)..(297): Utility: Useful for increasing chlorophyll and photosynthetic capacity
  misc_feature (1)..(297): Utility: Useful for making plants with increased biomass and foliage
  misc_feature (253)..(253): Xaa is any aa, unknown or other
  misc_feature (257)..(257): Xaa is any aa, unknown or other

SEQ ID NO: 6542 - protein, 302 aa, Glycine max
  misc_feature (1)..(302): useful for making plants with modified plant phenotypes as described in USSN 12/139,269
  misc_feature (1)..(302): Public GI no. 1149535
  misc_feature (1)..(302): Utility: Useful for increasing chlorophyll and photosynthetic capacity
  misc_feature (1)..(302): Utility: Useful for making plants with increased biomass and foliage
MMIHQREDHLGLSLSLSSPAHRPSSSSSPLQLNLAPSMPTPSTPPFNLFHKKETSDGYILDACRVETRSFLKGIDVNRLPATTVDMEEEAGVSSPNSTISSVSGKRSLERSENGNGDDLLDCSRGLINSDEEDGDNSRKKLRLSKDQSAILEDSFKEHNTLNPKQKLALAKRLGLRPRQVEVWFQNRRARTKLKQTEVDCEFLKRCCENLTDENRRLMKEVQELRALKLSPQFYMQMTPPTTLTMCPSCERVSAPPSSSTGPSSTPVETPRPHHSGSSHHRVAFNPWAIAPAGHRSFDAVPH

SEQ ID NO: 6543 - protein, 282 aa, Glycine max
  misc_feature (1)..(282): useful for making plants with modified plant phenotypes as described in USSN 12/139,269
  misc_feature (1)..(282): Public GI no. 18034437
  misc_feature (1)..(282): Utility: Useful for increasing chlorophyll and photosynthetic capacity
  misc_feature (1)..(282): Utility: Useful for making plants with increased biomass and foliage
LGLSLGSFGPSSSGGSHPPPALPLPSNLFRPSLQEIDRTQRSIGAFLQAPTAAAVCREPASAFRGIDVNRPPTIVDCGEENNNPIASPSPNSTVCSSSGKRTSGEREEKEDGDRAASSSFEVEDDDGGGGDASARKKLRLSKEQAVVLEETFKEHSTLNPKEKIALAKQLNLMPRQVEVWFQNRRARTKLKQTEVDCEYLRRCCENLTEENRRLQKEVNELRALKLSPQFYMSPPTTLTMCPQCERVAAQPSSAAAIRPPSHHQRPAAGMNSWAAMISPRPS

SEQ ID NO: 6544 - DNA, 639 bp, Arabidopsis thaliana
  misc_feature (1)..(639): useful for making plants with modified plant phenotypes as described in USSN 12/139,269
  misc_feature (1)..(639): Ceres CLONE ID no. 42925
  misc_feature (1)..(639): Also known as  Ceres CDNA ID no. 23374505
aactaccaccaattcaatccattgctcaaactctcttatcatctctaacacacccaccctacctacctccatctctctctctgcaacagagcacaaaaatggattctgcatcgtccaacaccaaagctatagaccctccacttcacatgttgggtttcgagttcgatgaattatctccgacacgtatcacaggtcgccttcctgtttctcccgtctgctgccagcctttcaaggtgttacacggtggtgtatctgctttgatagccgagtctttagcaagtatgggagctcacatggcttctggtttcaaaagggtcgctggaattcaactctcaatcaaccatttgaagagtgctgatcttggagaccttgtcttcgccgaagcaactcctgtaagcacagggaagactattcaggtttgggaagtcaagttatggaaaacaacacagaaagataaagctaacaaaatcttaatatcttcctctagagttacacttatctgtaatctacctatccctgataacgccaaagatgcagcaaacatgctcaaaatggtcgcaaagttgtagatttcttcaggcttttttgttttacttgtattgtatgtaatgacccatcttctcgaaattgataataagc

SEQ ID NO: 6545 - protein, 156 aa, Arabidopsis thaliana
  misc_feature (1)..(156): useful for making plants with modified plant phenotypes as described in USSN 12/139,269
  misc_feature (44)..(121): Pfam Name: 4HBT; Pfam Description: Thioesterase superfamily
  misc_feature (1)..(156): Utility: Useful for increasing chlorophyll and photosynthetic capacity
  misc_feature (1)..(156): Utility: Useful for increasing increasing anthocyanin content
  misc_feature (1)..(156): Utility: Useful for making lethal plants for genetic confinement systems
  misc_feature (1)..(156): Utility: Useful for making ornamental plants with modified flowers
  misc_feature (1)..(156): Utility: Useful for making ornamental plants with modified leaves
  misc_feature (1)..(156): Utility: Useful for making plants with increased biomass
  misc_feature (1)..(156): Utility: Useful for making plants with increased biomass and foliage
  misc_feature (1)..(156): Utility: Useful for making smaller plants
  misc_feature (1)..(156): Utility: Useful for modifying plant structure, ie increased branching
MDSASSNTKAIDPPLHMLGFEFDELSPTRITGRLPVSPVCCQPFKVLHGGVSALIAESLASMGAHMASGFKRVAGIQLSINHLKSADLGDLVFAEATPVSTGKTIQVWEVKLWKTTQKDKANKILISSSRVTLICNLPIPDNAKDAANMLKMVAKL

SEQ ID NO: 6546 - protein, 157 aa, Arabidopsis thaliana
  misc_feature (1)..(157): useful for making plants with modified plant phenotypes as described in USSN 12/139,269
  misc_feature (1)..(157): Ceres CLONE ID no. 13121
  misc_feature (1)..(157): Utility: Useful for increasing chlorophyll and photosynthetic capacity
  misc_feature (1)..(157): Utility: Useful for increasing increasing anthocyanin content
  misc_feature (1)..(157): Utility: Useful for making lethal plants for genetic confinement systems
  misc_feature (1)..(157): Utility: Useful for making ornamental plants with modified flowers
  misc_feature (1)..(157): Utility: Useful for making ornamental plants with modified leaves
  misc_feature (1)..(157): Utility: Useful for making plants with increased biomass
  misc_feature (1)..(157): Utility: Useful for making plants with increased biomass and foliage
  misc_feature (1)..(157): Utility: Useful for making smaller plants
  misc_feature (1)..(157): Utility: Useful for modifying plant structure, ie increased branching
MDPKSPEFIIDQPLKILGFVFDELSATRVSGHLTLTEKCCQPFKVLHGGVSALIAEALASLGAGIASGFKRVAGIHLSIHHLRPAALGEIVFAESFPVSVGKNIQVWEVRLWKAKKTETPDNKIMVSTSRVTLFCGLPIPDHVKDAPDELKKVISKL

SEQ ID NO: 6547 - protein, 157 aa, Arabidopsis thaliana; identical to SEQ ID NO: 6546
  misc_feature (1)..(157): useful for making plants with modified plant phenotypes as described in USSN 12/139,269
  misc_feature (1)..(157): Public GI no. 10177184
  misc_feature (1)..(157): Utility: Useful for increasing chlorophyll and photosynthetic capacity
  misc_feature (1)..(157): Utility: Useful for increasing increasing anthocyanin content
  misc_feature (1)..(157): Utility: Useful for making lethal plants for genetic confinement systems
  misc_feature (1)..(157): Utility: Useful for making ornamental plants with modified flowers
  misc_feature (1)..(157): Utility: Useful for making ornamental plants with modified leaves
  misc_feature (1)..(157): Utility: Useful for making plants with increased biomass
  misc_feature (1)..(157): Utility: Useful for making plants with increased biomass and foliage
  misc_feature (1)..(157): Utility: Useful for making smaller plants
  misc_feature (1)..(157): Utility: Useful for modifying plant structure, ie increased branching

SEQ ID NO: 6548 - protein, 154 aa, Brassica napus
  misc_feature (1)..(154): useful for making plants with modified plant phenotypes as described in USSN 12/139,269
  misc_feature (1)..(154): Ceres CLONE ID no. 980268
  misc_feature (1)..(154): Utility: Useful for increasing chlorophyll and photosynthetic capacity
  misc_feature (1)..(154): Utility: Useful for increasing increasing anthocyanin content
  misc_feature (1)..(154): Utility: Useful for making lethal plants for genetic confinement systems
  misc_feature (1)..(154): Utility: Useful for making ornamental plants with modified flowers
  misc_feature (1)..(154): Utility: Useful for making ornamental plants with modified leaves
  misc_feature (1)..(154): Utility: Useful for making plants with increased biomass
  misc_feature (1)..(154): Utility: Useful for making plants with increased biomass and foliage
  misc_feature (1)..(154): Utility: Useful for making smaller plants
  misc_feature (1)..(154): Utility: Useful for modifying plant structure, ie increased branching
MDPKSAEFTADNPLHILGFVFEELSATRVSGRLAVTDKCCQPFKVLHGGVSALIAEGLASLGAGIASGYKRVAGVHLSIHHIRPAALGESVFAESFPVSVGKNIQVWEVRLWKTKETEKRKMISTSRVTLLSGLPVPDHAKDSLDQLKKFVSKL

SEQ ID NO: 6549 - protein, 160 aa, Triticum aestivum
  misc_feature (1)..(160): useful for making plants with modified plant phenotypes as described in USSN 12/139,269
  misc_feature (1)..(160): Ceres CLONE ID no. 761821
  misc_feature (1)..(160): Utility: Useful for increasing chlorophyll and photosynthetic capacity
  misc_feature (1)..(160): Utility: Useful for increasing increasing anthocyanin content
  misc_feature (1)..(160): Utility: Useful for making lethal plants for genetic confinement systems
  misc_feature (1)..(160): Utility: Useful for making ornamental plants with modified flowers
  misc_feature (1)..(160): Utility: Useful for making ornamental plants with modified leaves
  misc_feature (1)..(160): Utility: Useful for making plants with increased biomass
  misc_feature (1)..(160): Utility: Useful for making plants with increased biomass and foliage
  misc_feature (1)..(160): Utility: Useful for making smaller plants
  misc_feature (1)..(160): Utility: Useful for modifying plant structure, ie increased branching
MAELDPVLHGVGFEMQEVSPSLLSGRLPVTERCCQPFKVLHGGVSALVAEGLASMGAHMASGYRRVAGVHLAINHFRSAALGDVVLARAVPVHLGRSTQVWEVKLWKMDPSEEGKKGPQISESRVTLLCNLPVPDNLHHAGDALKKYAAAATTPTPTSKL

SEQ ID NO: 6550 - protein, 164 aa, Triticum aestivum
  misc_feature (1)..(164): useful for making plants with modified plant phenotypes as described in USSN 12/139,269
  misc_feature (1)..(164): Public GI no. 50428638
  misc_feature (1)..(164): Utility: Useful for increasing chlorophyll and photosynthetic capacity
  misc_feature (1)..(164): Utility: Useful for increasing increasing anthocyanin content
  misc_feature (1)..(164): Utility: Useful for making lethal plants for genetic confinement systems
  misc_feature (1)..(164): Utility: Useful for making ornamental plants with modified flowers
  misc_feature (1)..(164): Utility: Useful for making ornamental plants with modified leaves
  misc_feature (1)..(164): Utility: Useful for making plants with increased biomass
  misc_feature (1)..(164): Utility: Useful for making plants with increased biomass and foliage
  misc_feature (1)..(164): Utility: Useful for making smaller plants
  misc_feature (1)..(164): Utility: Useful for modifying plant structure, ie increased branching
MDDATSSSSRAPRPKTEELDAALHAMGFEIERVSPAEVTGRLLVTPTCCQPFKVLHGGVSALIAEGLASMGAHMASGYSRVAGVQLSINHFRSAALGDTVLVRAAPLHVGRSTQVWAVKLWKLDPSTKEKGAQISESRVTLLCNLPVPESVKNAGEALKKYSKL

SEQ ID NO: 6551 - protein, 167 aa, Zea mays
  misc_feature (1)..(167): useful for making plants with modified plant phenotypes as described in USSN 12/139,269
  misc_feature (1)..(167): Ceres CLONE ID no. 1464627
  misc_feature (1)..(167): Utility: Useful for increasing chlorophyll and photosynthetic capacity
  misc_feature (1)..(167): Utility: Useful for increasing increasing anthocyanin content
  misc_feature (1)..(167): Utility: Useful for making lethal plants for genetic confinement systems
  misc_feature (1)..(167): Utility: Useful for making ornamental plants with modified flowers
  misc_feature (1)..(167): Utility: Useful for making ornamental plants with modified leaves
  misc_feature (1)..(167): Utility: Useful for making plants with increased biomass
  misc_feature (1)..(167): Utility: Useful for making plants with increased biomass and foliage
  misc_feature (1)..(167): Utility: Useful for making smaller plants
  misc_feature (1)..(167): Utility: Useful for modifying plant structure, ie increased branching
MGGGSGNPLPPPQAAAAAFRVDRPLQALGFEFTRVTAEEVVGRLPVTETCCQPFDWLNGGVSALMAETTASIGGYVASGYRRLAGVQLSINHVGPARLGDLVQARATPVQLGRKIQVWEVQIWRIDPSTSESKDLVSTARVTLLTNLPTPEKMKSFEQGLKKFSSKL

SEQ ID NO: 6552 - protein, 173 aa, Triticum aestivum
  misc_feature (1)..(173): useful for making plants with modified plant phenotypes as described in USSN 12/139,269
  misc_feature (1)..(173): Ceres CLONE ID no. 567431
  misc_feature (1)..(173): Utility: Useful for increasing chlorophyll and photosynthetic capacity
  misc_feature (1)..(173): Utility: Useful for increasing increasing anthocyanin content
  misc_feature (1)..(173): Utility: Useful for making lethal plants for genetic confinement systems
  misc_feature (1)..(173): Utility: Useful for making ornamental plants with modified flowers
  misc_feature (1)..(173): Utility: Useful for making ornamental plants with modified leaves
  misc_feature (1)..(173): Utility: Useful for making plants with increased biomass
  misc_feature (1)..(173): Utility: Useful for making plants with increased biomass and foliage
  misc_feature (1)..(173): Utility: Useful for making smaller plants
  misc_feature (1)..(173): Utility: Useful for modifying plant structure, ie increased branching
MAGSGESARTTAASPPGPPPGFGEGAPPDNALHALGFEYTRITGSEVLGRLAVTETCCQPFKILNGGVSALMAESTASIGGYMASGYRRVAGVQLSINHLKPARLGDRIEAKANPIQVGRNVQVWEVQIWLLDPATSEHKDLVSSARVTLLTNLSTPEEMKIYEKGIKKYAKL

SEQ ID NO: 6553 - DNA, 517 bp, Arabidopsis thaliana
  misc_feature (1)..(517): useful for making plants with modified plant phenotypes as described in USSN 12/139,269
  misc_feature (1)..(517): Ceres CLONE ID no. 94110
  misc_feature (1)..(517): Also known as  Ceres CDNA ID no. 23361789
gccatcttcttcattatcatcatctccatctctctctctctctcattttcttgaaaaagatgagaaccttaaagactcagaccacaaggggaaggagaagagcaaatgtgtcgttacgtacgagagttttacacacgtgctgtggaaatggtagtagcgacggagggaagacggtgatggagaagcttcttgcgttaaagagccttcttcctccaccggtgaatgtcggtggtggagagacggaggagctgtttcaagagacggcggagtatatcgtgaagcttagaacacaagtcgtggtgttgaagaaactgattgagatttacgataactcttctgatcagaagaaagatgttgttttataatgttcatttatattttctttaatttaaattatttcaggtttttctgttttttttttgttataaacttataattattatattgtgatccgtaattgttttaggttgtcgatgtctttaatgtattggttaaaaggaaaaagtattgatgattg

SEQ ID NO: 6554 - protein, 101 aa, Arabidopsis thaliana
  misc_feature (1)..(101): useful for making plants with modified plant phenotypes as described in USSN 12/139,269
  misc_feature (1)..(101): Utility: Useful for increasing chlorophyll and photosynthetic capacity
  misc_feature (1)..(101): Utility: Useful for increasing seed/fruit yield or modifying fruit content
  misc_feature (1)..(101): Utility: Useful for making plants sterile and for genetic confinement
  misc_feature (1)..(101): Utility: Useful for making plants with altered leaf shape eg curled leaves
  misc_feature (1)..(101): Utility: Useful for making plants with increased biomass and foliage
  misc_feature (1)..(101): Utility: Useful for making smaller plants
MRTLKTQTTRGRRRANVSLRTRVLHTCCGNGSSDGGKTVMEKLLALKSLLPPPVNVGGGETEELFQETAEYIVKLRTQVVVLKKLIEIYDNSSDQKKDVVL

SEQ ID NO: 6555 - DNA, 716 bp, Arabidopsis thaliana
  misc_feature (1)..(716): useful for making plants with modified plant phenotypes as described in USSN 12/139,269
  misc_feature (1)..(716): Ceres CLONE ID no. 95453
  misc_feature (1)..(716): Also known as  Ceres CDNA ID no. 23380898
  misc_feature (578)..(578): y is t/u or c
  misc_feature (579)..(579): r is g or a
  misc_feature (582)..(582): y is t/u or c
aacacatctcactgctcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacgaggaagcggtggcggcggaggccaccgtggaggtggtggcggtggtggaggttactccggtggaggtggtagctacggaggtggcggcggtagacgcgagggtggaggaggatacagcggcggcggcggttactcctcaagaggtggtggtggcggaagctacggtggtggaagacgtgagggaggaggaggatacggtggtggtgaaggaggaggttacggaggaagcggtggtggtggaggatggtaattctgttyratyaggtttgggattaccaatgaatgttctctctctcgcttgttatgcttctactttgttttgtgtgttctctattttgttctggttctgctttagatttgatgtaacagttcgtgattaggtattttggtatctgg

SEQ ID NO: 6556 - protein, 169 aa, Arabidopsis thaliana
  misc_feature (1)..(169): useful for making plants with modified plant phenotypes as described in USSN 12/139,269
  misc_feature (10)..(81): Pfam Name: RRM_1; Pfam Description: RNA recognition motif. (a.k.a. RRM, RBD, or RNP domain)
  misc_feature (48)..(164): Pfam Name: GRP; Pfam Description: Glycine rich protein family
  misc_feature (1)..(169): Utility: Useful for increasing chlorophyll and photosynthetic capacity
  misc_feature (1)..(169): Utility: Useful for making ornamental plants with modified flowers
  misc_feature (1)..(169): Utility: Useful for making plants sterile and for genetic confinement
  misc_feature (1)..(169): Utility: Useful for making plants with increased biomass and foliage
  misc_feature (1)..(169): Utility: Useful for making smaller plants
  misc_feature (1)..(169): Utility: Useful for making stronger plants
  misc_feature (118)..(118): Xaa is any aa, unknown or other
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGGGYSGGGGSYGGGGGXREGGGGYSGGGGYSSRGGGGGSYGGGRREGGGGYGGGEGGGYGGSGGGGGW

SEQ ID NO: 6557 - protein, 136 aa, Brassica napus; identical to SEQ ID NO: 5948
  misc_feature (1)..(136): useful for making plants with modified plant phenotypes as described in USSN 12/139,269
  misc_feature (1)..(136): Ceres CLONE ID no. 1091493
  misc_feature (1)..(136): Utility: Useful for increasing chlorophyll and photosynthetic capacity
  misc_feature (1)..(136): Utility: Useful for making ornamental plants with modified flowers
  misc_feature (1)..(136): Utility: Useful for making plants sterile and for genetic confinement
  misc_feature (1)..(136): Utility: Useful for making plants with increased biomass and foliage
  misc_feature (1)..(136): Utility: Useful for making smaller plants
  misc_feature (1)..(136): Utility: Useful for making stronger plants

SEQ ID NO: 6558 - protein, 134 aa, Brassica napus; identical to SEQ ID NO: 5947
  misc_feature (1)..(134): useful for making plants with modified plant phenotypes as described in USSN 12/139,269
  misc_feature (1)..(134): Ceres CLONE ID no. 977670
  misc_feature (1)..(134): Utility: Useful for increasing chlorophyll and photosynthetic capacity
  misc_feature (1)..(134): Utility: Useful for making ornamental plants with modified flowers
  misc_feature (1)..(134): Utility: Useful for making plants sterile and for genetic confinement
  misc_feature (1)..(134): Utility: Useful for making plants with increased biomass and foliage
  misc_feature (1)..(134): Utility: Useful for making smaller plants
  misc_feature (1)..(134): Utility: Useful for making stronger plants

SEQ ID NO: 6559 - protein, 151 aa, Brassica napus; identical to SEQ ID NO: 5949
  misc_feature (1)..(151): useful for making plants with modified plant phenotypes as described in USSN 12/139,269
  misc_feature (1)..(151): Ceres CLONE ID no. 945779
  misc_feature (1)..(151): Utility: Useful for increasing chlorophyll and photosynthetic capacity
  misc_feature (1)..(151): Utility: Useful for making ornamental plants with modified flowers
  misc_feature (1)..(151): Utility: Useful for making plants sterile and for genetic confinement
  misc_feature (1)..(151): Utility: Useful for making plants with increased biomass and foliage
  misc_feature (1)..(151): Utility: Useful for making smaller plants
  misc_feature (1)..(151): Utility: Useful for making stronger plants

SEQ ID NO: 6560 - protein, 146 aa, Brassica napus; identical to SEQ ID NO: 5951
  misc_feature (1)..(146): useful for making plants with modified plant phenotypes as described in USSN 12/139,269
  misc_feature (1)..(146): Ceres CLONE ID no. 965777
  misc_feature (1)..(146): Utility: Useful for increasing chlorophyll and photosynthetic capacity
  misc_feature (1)..(146): Utility: Useful for making ornamental plants with modified flowers
  misc_feature (1)..(146): Utility: Useful for making plants sterile and for genetic confinement
  misc_feature (1)..(146): Utility: Useful for making plants with increased biomass and foliage
  misc_feature (1)..(146): Utility: Useful for making smaller plants
  misc_feature (1)..(146): Utility: Useful for making stronger plants

SEQ ID NO: 6561 - protein, 153 aa, Brassica napus; identical to SEQ ID NO: 5950
  misc_feature (1)..(153): useful for making plants with modified plant phenotypes as described in USSN 12/139,269
  misc_feature (1)..(153): Ceres CLONE ID no. 1092319
  misc_feature (1)..(153): Utility: Useful for increasing chlorophyll and photosynthetic capacity
  misc_feature (1)..(153): Utility: Useful for making ornamental plants with modified flowers
  misc_feature (1)..(153): Utility: Useful for making plants sterile and for genetic confinement
  misc_feature (1)..(153): Utility: Useful for making plants with increased biomass and foliage
  misc_feature (1)..(153): Utility: Useful for making smaller plants
  misc_feature (1)..(153): Utility: Useful for making stronger plants

SEQ ID NO: 6562 - protein, 133 aa, Brassica napus; identical to SEQ ID NO: 5952
  misc_feature (1)..(133): useful for making plants with modified plant phenotypes as described in USSN 12/139,269
  misc_feature (1)..(133): Ceres CLONE ID no. 963616
  misc_feature (1)..(133): Utility: Useful for increasing chlorophyll and photosynthetic capacity
  misc_feature (1)..(133): Utility: Useful for making ornamental plants with modified flowers
  misc_feature (1)..(133): Utility: Useful for making plants sterile and for genetic confinement
  misc_feature (1)..(133): Utility: Useful for making plants with increased biomass and foliage
  misc_feature (1)..(133): Utility: Useful for making smaller plants
  misc_feature (1)..(133): Utility: Useful for making stronger plants
  misc_feature (13)..(13): Xaa is any aa, unknown or other

SEQ ID NO: 6563 - protein, 109 aa, Triticum aestivum
  misc_feature (1)..(109): useful for making plants with modified plant phenotypes as described in USSN 12/139,269
  misc_feature (1)..(109): Ceres CLONE ID no. 942159
  misc_feature (1)..(109): Utility: Useful for increasing chlorophyll and photosynthetic capacity
  misc_feature (1)..(109): Utility: Useful for making ornamental plants with modified flowers
  misc_feature (1)..(109): Utility: Useful for making plants sterile and for genetic confinement
  misc_feature (1)..(109): Utility: Useful for making plants with increased biomass and foliage
  misc_feature (1)..(109): Utility: Useful for making smaller plants
  misc_feature (1)..(109): Utility: Useful for making stronger plants
  misc_feature (12)..(12): Xaa is any aa, unknown or other
MADVEYRCFVGXLAWATDDQSLQNAFSKYGDVIDSKIITDRETGRSRGFGFVTFASDEAMRQAIEAMNGQDLDGRNITVNEAQSRRSGGGGGGFGGGGGGGGYGGQRRE

SEQ ID NO: 6564 - protein, 189 aa, Glycine max
  misc_feature (1)..(189): useful for making plants with modified plant phenotypes as described in USSN 12/139,269
  misc_feature (1)..(189): Ceres CLONE ID no. 583672
  misc_feature (1)..(189): Utility: Useful for increasing chlorophyll and photosynthetic capacity
  misc_feature (1)..(189): Utility: Useful for making ornamental plants with modified flowers
  misc_feature (1)..(189): Utility: Useful for making plants sterile and for genetic confinement
  misc_feature (1)..(189): Utility: Useful for making plants with increased biomass and foliage
  misc_feature (1)..(189): Utility: Useful for making smaller plants
  misc_feature (1)..(189): Utility: Useful for making stronger plants
SASLTPLNTNFLGFIQFSMASSDVEYRCFVGGLAWATDDQALERAFSQYGEIVETKIINDRETGRSRGFGFVTFASEQSMKDAIEGMNGQNLDGRNITVNEAQSRGGGGGGGGGGGGYGGGRGGGYGGGGRGGGGGYNRSGGGGGYGGGGGYGGGGGGGYGGGRDRGYGGGGDRGYSRGGDGGDGGWRN

SEQ ID NO: 6565 - protein, 193 aa, Zea mays
  misc_feature (1)..(193): useful for making plants with modified plant phenotypes as described in USSN 12/139,269
  misc_feature (1)..(193): Ceres CLONE ID no. 258380
  misc_feature (1)..(193): Utility: Useful for increasing chlorophyll and photosynthetic capacity
  misc_feature (1)..(193): Utility: Useful for making ornamental plants with modified flowers
  misc_feature (1)..(193): Utility: Useful for making plants sterile and for genetic confinement
  misc_feature (1)..(193): Utility: Useful for making plants with increased biomass and foliage
  misc_feature (1)..(193): Utility: Useful for making smaller plants
  misc_feature (1)..(193): Utility: Useful for making stronger plants
MGYEDEPPEPEIEEGAEEEPENNEDAGWLLLPHRFVFRFWFVGEREEMAASDVEYRCFVGGLAWATDDHSLNNAFSTYGEVLESKIILDRETQRSRGFGFVTFSTEDAMRSAIEGMNGKELDGRNITVNEAQSRGGRGGGGGGYGGGRRDGGGYGGGGGGYGGGRGGYGGGGGGYGGGNRGGGYGNNDGNWRN

SEQ ID NO: 6566 - protein, 123 aa, Brassica napus; identical to SEQ ID NO: 5953
  misc_feature (1)..(123): useful for making plants with modified plant phenotypes as described in USSN 12/139,269
  misc_feature (1)..(123): Ceres CLONE ID no. 972545
  misc_feature (1)..(123): Utility: Useful for increasing chlorophyll and photosynthetic capacity
  misc_feature (1)..(123): Utility: Useful for making ornamental plants with modified flowers
  misc_feature (1)..(123): Utility: Useful for making plants sterile and for genetic confinement
  misc_feature (1)..(123): Utility: Useful for making plants with increased biomass and foliage
  misc_feature (1)..(123): Utility: Useful for making smaller plants
  misc_feature (1)..(123): Utility: Useful for making stronger plants
  misc_feature (11)..(11): Xaa is any aa, unknown or other
  misc_feature (27)..(27): Xaa is any aa, unknown or other
  misc_feature (78)..(78): Xaa is any aa, unknown or other
  misc_feature (80)..(80): Xaa is any aa, unknown or other
  misc_feature (108)..(108): Xaa is any aa, unknown or other
  misc_feature (120)..(120): Xaa is any aa, unknown or other

SEQ ID NO: 6567 - protein, 147 aa, Glycine max
  misc_feature (1)..(147): useful for making plants with modified plant phenotypes as described in USSN 12/139,269
  misc_feature (1)..(147): Ceres CLONE ID no. 1101112
  misc_feature (1)..(147): Utility: Useful for increasing chlorophyll and photosynthetic capacity
  misc_feature (1)..(147): Utility: Useful for making ornamental plants with modified flowers
  misc_feature (1)..(147): Utility: Useful for making plants sterile and for genetic confinement
  misc_feature (1)..(147): Utility: Useful for making plants with increased biomass and foliage
  misc_feature (1)..(147): Utility: Useful for making smaller plants
  misc_feature (1)..(147): Utility: Useful for making stronger plants
MASADVEYRCFVGGLAWATDNYDLEKAFSQYGDVVESKIINDRETGRSRGFGFVTFASEDSMRDAIEGMNGQNLDGRNITVNEAQSRGSRGGGGGGYGSGGGYNRSGGAGGYGGRREGAYNRNGGGYGGDRDHRYGPYGDGGSRYSR

SEQ ID NO: 6568 - DNA, 1645 bp, Arabidopsis thaliana
  misc_feature (1)..(1645): useful for making plants with modified plant phenotypes as described in USSN 12/139,269
  misc_feature (1)..(1645): Ceres CLONE ID no. 96020
  misc_feature (1)..(1645): Also known as  Ceres CDNA ID no. 23556777
agtgttactgtaacagtcgcacacctaacaaaaatcctccagccatggcggcagttactcaatttctctcccaaccttcatcaatccgcggaaccctaaatcagtaccaattgaatcagacttcactctcaagaatcccatttttgtctctcaagtcaacattgaagccactcaaacgcctctccgtcaaagccgccgtttcccaaaactccaccaaaaccctcacgaaagaatctgcttcctctttcgaccactgtttcaagaaatcatcagatgggtttctctattgcgaaggaaccaaggttcaagatatcatggaaacagtcgagaaacgacccttttacttatatagcaaacctcagatcacgagaaaccttgaggcttataaagaggctttggaaggagtgagatctgttattggttacgctattaaagctaataacaatctcaagattttggagtatttgaggagtttgggctgtggtgctgtgttggttagtggaaatgagctcaggcttgctcttcttgctggtttcgatcccacaaagtgtattttcaatggaaatggaaagtctttggaagatttagttctagctgctcaagaaggtgttttcgtaaatgttgatagtgagtttgacttgaataacattgtggaagcttcaagaatttctggtaagcaggtcaatgtattgttgcgtatcaatcctgatgttgatcctcaggtgcatccatatgtagctactgggaacaagaactcgaagtttggtattaggaacgagaagcttcaatggtttctggatgaagtgaaggcacatcccaaagagctgaagcttgttggagctcattgtcatcttggttctaccattacaaaggtggatatattcagagatgctgcggttctcatgattgaatacattgatgaaatccggcgtcaaggctttgaggttagctacttgaacattggtggtggtttagggatagattattatcatgccggcgctgtccttcctacacccatggatcttatcaacaccgtaagagagctggttctttcacgagacctgaatctaataatcgagccagggagatcactgattgcaaacacatgttgtttcgtcaactatgtaactggtgtgaagacgaatggaactaaaaacttcatagtgattgatggaagtatggctgagcttatccgtcccagtctttatgatgcctatcagcatattgagttggtctctcctacaccgcctgaagcagaggttaccaaattcgatgtagtgggtcctgtttgtgaatctgctgatttcttgggcaaagacagagagcttcccactcctccacagggagctggtctctggttcatgacgctggtgcatactgtatgagtatggcttccacttacaatctcaagatgcgtcccccggaatactgggttgaagaagatgggtcgatcactaagatcaggcatgctgagacattcgatgaccatttacgtttctttgaaggactatgaactccgagatttactcatcattgttgctattttagatgaattgtatgattacgtttctataatgctattgctgtcttggatttttccacattctgtgctatgatttaaagtcctcaataaagtgatcatatg

SEQ ID NO: 6569 - protein, 446 aa, Arabidopsis thaliana
  misc_feature (1)..(446): useful for making plants with modified plant phenotypes as described in USSN 12/139,269
  misc_feature (103)..(353): Pfam Name: Orn_Arg_deC_N; Pfam Description: Pyridoxal-dependent decarboxylase, pyridoxal binding domain
  misc_feature (361)..(440): Pfam Name: Orn_DAP_Arg_deC; Pfam Description: Pyridoxal-dependent decarboxylase, C-terminal sheet domain
  misc_feature (1)..(446): Utility: Useful for increasing chlorophyll and photosynthetic capacity
  misc_feature (1)..(446): Utility: Useful for making larger plants
  misc_feature (1)..(446): Utility: Useful for making ornamental plants with modified flowers
  misc_feature (1)..(446): Utility: Useful for making plants sterile and for genetic confinement
  misc_feature (1)..(446): Utility: Useful for making plants with altered leaf shape eg curled leaves
  misc_feature (1)..(446): Utility: Useful for making plants with increased biomass and foliage
  misc_feature (1)..(446): Utility: Useful for making smaller plants
  misc_feature (1)..(446): Utility: Useful for modifying plant structure, ie increased branching
MAAVTQFLSQPSSIRGTLNQYQLNQTSLSRIPFLSLKSTLKPLKRLSVKAAVSQNSTKTLTKESASSFDHCFKKSSDGFLYCEGTKVQDIMETVEKRPFYLYSKPQITRNLEAYKEALEGVRSVIGYAIKANNNLKILEYLRSLGCGAVLVSGNELRLALLAGFDPTKCIFNGNGKSLEDLVLAAQEGVFVNVDSEFDLNNIVEASRISGKQVNVLLRINPDVDPQVHPYVATGNKNSKFGIRNEKLQWFLDEVKAHPKELKLVGAHCHLGSTITKVDIFRDAAVLMIEYIDEIRRQGFEVSYLNIGGGLGIDYYHAGAVLPTPMDLINTVRELVLSRDLNLIIEPGRSLIANTCCFVNYVTGVKTNGTKNFIVIDGSMAELIRPSLYDAYQHIELVSPTPPEAEVTKFDVVGPVCESADFLGKDRELPTPPQGAGLWFMTLVHTV

SEQ ID NO: 6570 - protein, 484 aa, Arabidopsis thaliana
  misc_feature (1)..(484): useful for making plants with modified plant phenotypes as described in USSN 12/139,269
  misc_feature (1)..(484): Ceres CLONE ID no. 6579
  misc_feature (1)..(484): Utility: Useful for increasing chlorophyll and photosynthetic capacity
  misc_feature (1)..(484): Utility: Useful for making larger plants
  misc_feature (1)..(484): Utility: Useful for making ornamental plants with modified flowers
  misc_feature (1)..(484): Utility: Useful for making plants sterile and for genetic confinement
  misc_feature (1)..(484): Utility: Useful for making plants with altered leaf shape eg curled leaves
  misc_feature (1)..(484): Utility: Useful for making plants with increased biomass and foliage
  misc_feature (1)..(484): Utility: Useful for making smaller plants
  misc_feature (1)..(484): Utility: Useful for modifying plant structure, ie increased branching
MAAATQFLSQPSSLNPHQLKNQTSQRSRSIPVLSLKSTLKPLKRLSVKAAVVSQNSSKTVTKFDHCFKKSSDGFLYCEGTKVEDIMESVERRPFYLYSKPQITRNLEAYKEALEGVSSVIGYAIKANNNLKILEHLRSLGCGAVLVSGNELRLALRAGFDPTKCIFNGNGKSLEDLVLAAQEGVFVNVDSEFDLNNIVEASRISGKQVNVLLRINPDVDPQVHPYVATGNKNSKFGIRNEKLQWFLDQVKAHPKELKLVGAHCHLGSTITKVDIFRDAAVLMIEYIDEIRRQGFEVSYLNIGGGLGIDYYHAGAVLPTPMDLINTVRELVLSRDLNLIIEPGRSLIANTCCFVNHVTGVKTNGTKNFIVIDGSMAELIRPSLYDAYQHIELVSPPPAEAEVTKFDVVGPVCESADFLGKDRELPTPPQGAGLVVHDAGAYCMSMASTYNLKMRPPEYWVEEDGSITKIRHAETFDDHLRFFEGL

SEQ ID NO: 6571 - protein, 488 aa, Glycine max
  misc_feature (1)..(488): useful for making plants with modified plant phenotypes as described in USSN 12/139,269
  misc_feature (1)..(488): Ceres CLONE ID no. 593648
  misc_feature (1)..(488): Utility: Useful for increasing chlorophyll and photosynthetic capacity
  misc_feature (1)..(488): Utility: Useful for making larger plants
  misc_feature (1)..(488): Utility: Useful for making ornamental plants with modified flowers
  misc_feature (1)..(488): Utility: Useful for making plants sterile and for genetic confinement
  misc_feature (1)..(488): Utility: Useful for making plants with altered leaf shape eg curled leaves
  misc_feature (1)..(488): Utility: Useful for making plants with increased biomass and foliage
  misc_feature (1)..(488): Utility: Useful for making smaller plants
  misc_feature (1)..(488): Utility: Useful for modifying plant structure, ie increased branching
MAGSHLLSHSPSLPKTYNYSLNQNPLSQNLFFPPLKFKSTTKPRVLRAVLSQNAAKTAVEDTKNAHFQHCFTKSEDGYLYCEGLKVHDIMESVERRPFYLYSKPQITRNVEAYKDALEGLSSIIGYAIKANNNLKILEHLRHLGCGAVLVSGNELRLALRAGFDPTRCIFNGNGKILEDLVLAAQEGVFVNIDSEFDLENITEAAKRAGKKVNVLLRINPDVDPQVHPYVATGNKNSKFGIRNEKLQWFLDAVKELPNELKLVGAHCHLGSTITKVDIFRDAATIMINYIDQIRDQGFEVDYLNIGGGLGIDYYHSGAILPTPRDLIDTVRDLVISRGLNLIIEPGRSLIANTCCLVNRVTGVKSNGSKNFIVIDGSMAELIRPSLYDAYQHIELVSPAPSNAETTTFDVVGPVCESADFLGKGRELPTPAKGTGLVVHDAGAYCMSMASTYNLKMRPPEYWVEDDGSVSKIRHGETFEDHIRFFEGL

SEQ ID NO: 6572 - protein, 488 aa, Zea mays
  misc_feature (1)..(488): useful for making plants with modified plant phenotypes as described in USSN 12/139,269
  misc_feature (1)..(488): Ceres CLONE ID no. 218466
  misc_feature (1)..(488): Utility: Useful for increasing chlorophyll and photosynthetic capacity
  misc_feature (1)..(488): Utility: Useful for making larger plants
  misc_feature (1)..(488): Utility: Useful for making ornamental plants with modified flowers
  misc_feature (1)..(488): Utility: Useful for making plants sterile and for genetic confinement
  misc_feature (1)..(488): Utility: Useful for making plants with altered leaf shape eg curled leaves
  misc_feature (1)..(488): Utility: Useful for making plants with increased biomass and foliage
  misc_feature (1)..(488): Utility: Useful for making smaller plants
  misc_feature (1)..(488): Utility: Useful for modifying plant structure, ie increased branching
MASASMLARSLLRTPDPTQTSHPNRRSAAVVSFPRRHRRLSVRASVSTACPSPPPQPAAAAAGVPKHCFRRGADGYLYCEGVRVEDAMTAAERSPFYLYSKPQILRNFAAYRDALQGLRSIIGYAVKANNNLPVLRVLRELGCGAVLVSGNELRLALQAGFDPARCIFNGNGKTLEDLKLAAESGVFVNVDSEFDLENIVRAARATGKKVPVLLRINPDVDPQVHPYVATGNKTSKFGIRNEKLQWFLDSIKSYPNEIKLVGVHCHLGSTITKVDIFRDAAVLMVNYVDEIRAQGFKLEYLNIGGGLGIDYHHTDAVLPTPMDLINTVRELVLSQDLTLIIEPGRSLIANTCCFVNRVTGVKSNGTKNFIVVDGSMAELIRPSLYGAYQHIELVSPPTPGAEVATFDIVGPVCESADFLGKDRELPTPDEGAGLVVHDAGAYCMSMASTYNLKLRPPEYWVEADGSIVKIRHGEKLDDYMKFFDGLPA

SEQ ID NO: 6573 - protein, 490 aa, Zea mays
  misc_feature (1)..(490): useful for making plants with modified plant phenotypes as described in USSN 12/139,269
  misc_feature (1)..(490): Public GI no. 50907773
  misc_feature (1)..(490): Utility: Useful for increasing chlorophyll and photosynthetic capacity
  misc_feature (1)..(490): Utility: Useful for making larger plants
  misc_feature (1)..(490): Utility: Useful for making ornamental plants with modified flowers
  misc_feature (1)..(490): Utility: Useful for making plants sterile and for genetic confinement
  misc_feature (1)..(490): Utility: Useful for making plants with altered leaf shape eg curled leaves
  misc_feature (1)..(490): Utility: Useful for making plants with increased biomass and foliage
  misc_feature (1)..(490): Utility: Useful for making smaller plants
  misc_feature (1)..(490): Utility: Useful for modifying plant structure, ie increased branching
MAAANLLSRALLPALNPNPSSHSNRVSPSAVSLRCRHGLTASVRASLSTAAPSPPPRPAAAAADGRAPKRCFRRGADGHLYCEGVRVEDAMGAAERTPFYLYSKPQVVRNFTAYRDALEGLRSIVGYAVKANNNLRVLQLLRELGCGAVLVSGNELRLALRAGFDPTRCIFNGNGKTLEDLVLAAESGVFVNIDSEFDLENIVTAARVAGKKVPVLLRINPDVDPQVHPYVATGNKTSKFGIRNEKLQWFLDSIKSYSNDITLVGVHCHLGSTITKVDIFRDAAGLMVNYVDEIRAQGFELEYLNIGGGLGIDYHHTDAVLPTPMDLINTVRELVLSRDLTLIIEPGRSLIANTCCFVNRVTGVKSNGTKNFIVVDGSMAELIRPSLYGAYQHIELVSPSPDAEVATFDIVGPVCESADFLGKDRELPTPDKGAGLVVHDAGAYCMSMASTYNLKLRPPEYWVEDDGSIAKIRRGESFDDYMKFFDNLSA

SEQ ID NO: 6574 - protein, 484 aa, Triticum aestivum
  misc_feature (1)..(484): useful for making plants with modified plant phenotypes as described in USSN 12/139,269
  misc_feature (1)..(484): Ceres CLONE ID no. 697349
  misc_feature (1)..(484): Utility: Useful for increasing chlorophyll and photosynthetic capacity
  misc_feature (1)..(484): Utility: Useful for making larger plants
  misc_feature (1)..(484): Utility: Useful for making ornamental plants with modified flowers
  misc_feature (1)..(484): Utility: Useful for making plants sterile and for genetic confinement
  misc_feature (1)..(484): Utility: Useful for making plants with altered leaf shape eg curled leaves
  misc_feature (1)..(484): Utility: Useful for making plants with increased biomass and foliage
  misc_feature (1)..(484): Utility: Useful for making smaller plants
  misc_feature (1)..(484): Utility: Useful for modifying plant structure, ie increased branching
MAAANLLSRSLVPSLTPNPGSQPSRSRAASVSLRRRHGPAAPLRASLSTASPSTRVAMGEAPKHCFQRGADGHLYCEGVRVEDTMAAADRTPFYLYSKPQVVRNFTAYDKALQGLRSIVGYAVKANNNLSVLQLLRGLGCGAVLVSGNELRLALRAGFDPTRCIFNGNGKTLEDLVLAAESGVFVNIDSEFDLENIVTAARVAGRQVPVLLRINPDVDPQVHPYVATGNKTSKFGIRNEKLQWFLDSIKSYSNDIKLVGVHCHLGSTITKVDIFRDAANLMVNFVDEIRAQGFELEYLNIGGGLGIDYHHTGAVLPTPMDLINTVRELVLSRDLTLIIEPGRSLIANTCCFVNKVTGVKSNGTKNFIVVDGSMAELIRPSLYGAYQHIELVSPSPGAEVATFDIVGPVCESADFLGKDRELPTPEKGAGLVVHDAGAYCMSMASTYNLKMRPAEYWVEDDGSIVKIRHGETFDDYMKFFDGLPA

SEQ ID NO: 6575 - DNA, 675 bp, Arabidopsis thaliana
  misc_feature (1)..(675): useful for making plants with modified plant phenotypes as described in USSN 12/139,269
  misc_feature (1)..(675): Ceres CLONE ID no. 97415
  misc_feature (1)..(675): Also known as  Ceres CDNA ID no. 23361863
  misc_feature (586)..(586): w is a or t/u
  misc_feature (587)..(587): w is a or t/u
atactatcaaattgaagaagaggaagatccaattggaaagggttatcctaattcccagtcattgatcggagaagatgagtgctgttgcgattaaccacttttttggcttaccggagacgatcgagaagctaattctcccgatttctcgttccggcgaaagtaataacgagagtcgtggaagaggaagtagcaataatatcccaatagacattttggaatctcccaaaaaatacatattttatctcgatatccccggaatttcaaaatcagatatccaggttacagtggaggaagagaggactttagtgataaagagtaatgggaagaggaagagagatgatgatgagagtgaagaagggtctaagtatattagactcgagaggagacttgctcagaatttggttaagaagttccggttaccagaagatgctgatatggcttctgtaacggctaaatatcaagaaggtattttgacagttgttatcaagaagctaccgccacagccgccgaaacctaagactgttcaaatcgctgtttcttgagtagtttctgtgttttgtttttgtgtgtgtttgttttctagtawwgtaatttttctgtttttggataaaaagactctgtttcttttatgtgttctctagtcgaaattttgaaattgaagaaataaataggttt

SEQ ID NO: 6576 - protein, 155 aa, Arabidopsis thaliana
  misc_feature (1)..(155): useful for making plants with modified plant phenotypes as described in USSN 12/139,269
  misc_feature (45)..(153): Pfam Name: HSP20; Pfam Description: Hsp20/alpha crystallin family
  misc_feature (45)..(153): Pfam Name: HSP20; Pfam Description: Hsp20/alpha crystallin family
  misc_feature (1)..(155): Utility: Useful for increasing chlorophyll and photosynthetic capacity
  misc_feature (1)..(155): Utility: Useful for increasing seed/fruit yield or modifying fruit content
  misc_feature (1)..(155): Utility: Useful for making ornamental plants with modified leaves
  misc_feature (1)..(155): Utility: Useful for making plants sterile and for genetic confinement
  misc_feature (1)..(155): Utility: Useful for making plants with altered leaf shape eg curled leaves
  misc_feature (1)..(155): Utility: Useful for making plants with increased biomass and foliage
MSAVAINHFFGLPETIEKLILPISRSGESNNESRGRGSSNNIPIDILESPKKYIFYLDIPGISKSDIQVTVEEERTLVIKSNGKRKRDDDESEEGSKYIRLERRLAQNLVKKFRLPEDADMASVTAKYQEGILTVVIKKLPPQPPKPKTVQIAVS

SEQ ID NO: 6577 - protein, 154 aa, Brassica napus
  misc_feature (1)..(154): useful for making plants with modified plant phenotypes as described in USSN 12/139,269
  misc_feature (1)..(154): Ceres CLONE ID no. 940194
  misc_feature (1)..(154): Utility: Useful for increasing chlorophyll and photosynthetic capacity
  misc_feature (1)..(154): Utility: Useful for increasing seed/fruit yield or modifying fruit content
  misc_feature (1)..(154): Utility: Useful for making ornamental plants with modified leaves
  misc_feature (1)..(154): Utility: Useful for making plants sterile and for genetic confinement
  misc_feature (1)..(154): Utility: Useful for making plants with altered leaf shape eg curled leaves
  misc_feature (1)..(154): Utility: Useful for making plants with increased biomass and foliage
  misc_feature (146)..(146): Xaa is any aa, unknown or other
MNAVAINHLFGLPETIEKLIFPTSRSSEGNETRGGSNNNIPIDILESPKEYIFYVDIPGISKSDIQVTVEEERTLVIKSNGKRKREDHDESEEGCKYIRLERRLPQNLVKKFRLPEDADVEAVAAKYQDGVLTVTVGKVPPQPPKXKTVQIAVS

SEQ ID NO: 6578 - protein, 132 aa, Glycine max
  misc_feature (1)..(132): useful for making plants with modified plant phenotypes as described in USSN 12/139,269
  misc_feature (1)..(132): Ceres CLONE ID no. 637786
  misc_feature (1)..(132): Utility: Useful for increasing chlorophyll and photosynthetic capacity
  misc_feature (1)..(132): Utility: Useful for increasing seed/fruit yield or modifying fruit content
  misc_feature (1)..(132): Utility: Useful for making ornamental plants with modified leaves
  misc_feature (1)..(132): Utility: Useful for making plants sterile and for genetic confinement
  misc_feature (1)..(132): Utility: Useful for making plants with altered leaf shape eg curled leaves
  misc_feature (1)..(132): Utility: Useful for making plants with increased biomass and foliage
MFPSSRAHDHHHETRGVSSIIPVDILDTPKEYTFFMDVPGLSKSEIQVTVEDENTLVIRSNGKRKRQDGEDEGCKYLRLERRGPQNLQRKFRLPENANVSAITAKCENGVLTVVVEKHPPPQKSKTVEVAIA

SEQ ID NO: 6579 - protein, 144 aa, Glycine max
  misc_feature (1)..(144): useful for making plants with modified plant phenotypes as described in USSN 12/139,269
  misc_feature (1)..(144): Public GI no. 15148884
  misc_feature (1)..(144): Utility: Useful for increasing chlorophyll and photosynthetic capacity
  misc_feature (1)..(144): Utility: Useful for increasing seed/fruit yield or modifying fruit content
  misc_feature (1)..(144): Utility: Useful for making ornamental plants with modified leaves
  misc_feature (1)..(144): Utility: Useful for making plants sterile and for genetic confinement
  misc_feature (1)..(144): Utility: Useful for making plants with altered leaf shape eg curled leaves
  misc_feature (1)..(144): Utility: Useful for making plants with increased biomass and foliage
MSTVVDVVSQLLFPESIERLVSPSRSNESKGTIPVDILDTPKEYIFYMDVPGLSKSDLQVSVEDEKTLVIRSNGKRKREESEEEGCKYVRLERNPPLKLMRKFKLPDYCNVSAITAKCENGVLTVVVEKMPPPSKAKTVKVAVS

SEQ ID NO: 6580 - protein, 160 aa, Glycine max
  misc_feature (1)..(160): useful for making plants with modified plant phenotypes as described in USSN 12/139,269
  misc_feature (1)..(160): Public GI no. 472940
  misc_feature (1)..(160): Utility: Useful for increasing chlorophyll and photosynthetic capacity
  misc_feature (1)..(160): Utility: Useful for increasing seed/fruit yield or modifying fruit content
  misc_feature (1)..(160): Utility: Useful for making ornamental plants with modified leaves
  misc_feature (1)..(160): Utility: Useful for making plants sterile and for genetic confinement
  misc_feature (1)..(160): Utility: Useful for making plants with altered leaf shape eg curled leaves
  misc_feature (1)..(160): Utility: Useful for making plants with increased biomass and foliage
MDIDSLMGFDPLLRNLHYILEATDDNTTGNKSNNSGPSRAYVRDARAMAATPADVKECPNSYVFIVDMPGLKSGDIKVQVERDNVLVISGKRNREEEKEGVKYVRMERRMGKFMKKFALPEDANTDKISAICQDGVLTVTVEKLPPPEPKKPKTIQVQVA

SEQ ID NO: 6581 - protein, 178 aa, Triticum aestivum
  misc_feature (1)..(178): useful for making plants with modified plant phenotypes as described in USSN 12/139,269
  misc_feature (1)..(178): Ceres CLONE ID no. 923131
  misc_feature (1)..(178): Utility: Useful for increasing chlorophyll and photosynthetic capacity
  misc_feature (1)..(178): Utility: Useful for increasing seed/fruit yield or modifying fruit content
  misc_feature (1)..(178): Utility: Useful for making ornamental plants with modified leaves
  misc_feature (1)..(178): Utility: Useful for making plants sterile and for genetic confinement
  misc_feature (1)..(178): Utility: Useful for making plants with altered leaf shape eg curled leaves
  misc_feature (1)..(178): Utility: Useful for making plants with increased biomass and foliage
MAELLFAPAVAGLVHLPEVLERLAAADADHRDRAHHHAAHGHGHGHPGAQIGAGGVGGGAPVDIVETPGEYAFLLDVPGLSKSDIQVTLEEDNVLVMKSASNGGANGKRKREDEEADCRYIRLERRASPRSFVRKFRLPEDADAGAVAARCENGVLTVTVKKQPPPEKKTKSVQVAIA

SEQ ID NO: 6582 - protein, 174 aa, Zea mays
  misc_feature (1)..(174): useful for making plants with modified plant phenotypes as described in USSN 12/139,269
  misc_feature (1)..(174): Ceres CLONE ID no. 355400
  misc_feature (1)..(174): Utility: Useful for increasing chlorophyll and photosynthetic capacity
  misc_feature (1)..(174): Utility: Useful for increasing seed/fruit yield or modifying fruit content
  misc_feature (1)..(174): Utility: Useful for making ornamental plants with modified leaves
  misc_feature (1)..(174): Utility: Useful for making plants sterile and for genetic confinement
  misc_feature (1)..(174): Utility: Useful for making plants with altered leaf shape eg curled leaves
  misc_feature (1)..(174): Utility: Useful for making plants with increased biomass and foliage
MTELFDTALTSLLHLPEVLDRLAAADGDRRSAGHHAAHGHGHGHGHGRVHGLGGGGAPVDIVESPREYAFVLDVPGLSKSDIQVTLEEDRVLVMKGGSGKRKRDEEEDMNGEGCRYIRLERGAAPRSFVRKFRLPEDADTGGVAARCENGVLTVTVKKLPPPEKKAKTVQVTIA

SEQ ID NO: 6583 - protein, 172 aa, Zea mays
  misc_feature (1)..(172): useful for making plants with modified plant phenotypes as described in USSN 12/139,269
  misc_feature (1)..(172): Public GI no. 50915316
  misc_feature (1)..(172): Utility: Useful for increasing chlorophyll and photosynthetic capacity
  misc_feature (1)..(172): Utility: Useful for increasing seed/fruit yield or modifying fruit content
  misc_feature (1)..(172): Utility: Useful for making ornamental plants with modified leaves
  misc_feature (1)..(172): Utility: Useful for making plants sterile and for genetic confinement
  misc_feature (1)..(172): Utility: Useful for making plants with altered leaf shape eg curled leaves
  misc_feature (1)..(172): Utility: Useful for making plants with increased biomass and foliage
MTELFDTAVTSLLHLPEVLDRLGAAAGDRRSAGDHAHHAAHGHGQHRISGIGGGAPVDIMETPGEYAFVLDVPGLSKSDIQVTLEEDRVLVMKSSNGAGNGKRKREEEEGECKYIRLERRASPRAFARKFRLPEDADTGGISARCENGVLTVTVKKRPPPEKKTKSVQVTIA

SEQ ID NO: 6584 - DNA, 884 bp, Arabidopsis thaliana
  misc_feature (1)..(884): useful for making plants with modified plant phenotypes as described in USSN 12/139,269
  misc_feature (1)..(884): Ceres CLONE ID no. 98340
  misc_feature (1)..(884): Also known as  Ceres CDNA ID no. 23386113
  misc_feature (441)..(441): r is g or a
  misc_feature (442)..(442): r is g or a
  misc_feature (469)..(469): s is g or c
  misc_feature (470)..(470): y is t/u or c
aacaacataaaagacgatcaatataatctagaaaaaaaaagagaagagagaagagagaaatgtcgagagctttgtcagtcgtttgtgtcttgctcgccatatccttcgtctgtgcacgtgctcgtcaggtgccgggagagtctgatgagggaaaaacgacgggacatgacgatacaacaacaatgcccatgcatgcaaaagcagctgatcagttaccaccaaagagcgtcggcgacaaaaaatgcatcggaggagttgctggagtcggtggattcgccggaggttggtggtgttgccggcgtgggaggtctagggatgccactcatcggtggtcttgggcggggatcggtaagtatggtggcataggcggtgcagctggaatcggtggatttcatagtataggcggtgttggcgttctaggcggtgtcggaggaggtgttrrcaggtctaggcggtgttggagggggtsytggtggtctaggtggcgttggcggtctaggtggagctggtttaggcggtgtaggtggtgttggcggtggtattggtaaagccggtggtattggcggtttaggtggtctaggcggagccggaggtggtttaggtggagttggtggtctcggtaaggctggtggtattggtgttggtggtggtatcggtggtggacacggcgtggtcggtggtgtgatcgatccacatccttaatagagagtatttgttggttagggttttaattaaggaataattaattagtttcgatgttattgttggtcttttaattctgtgatcattagggtgacttttgatctattttctagtttgggcttttgtaacgtttgctttgatttcggccgtggtgttatgaaatgtgcgactctctatgtttg

SEQ ID NO: 6585 - protein, 161 aa, Arabidopsis thaliana
  misc_feature (1)..(161): useful for making plants with modified plant phenotypes as described in USSN 12/139,269
  misc_feature (1)..(161): Utility: Useful for increasing chlorophyll and photosynthetic capacity
  misc_feature (1)..(161): Utility: Useful for increasing seed/fruit yield or modifying fruit content
  misc_feature (1)..(161): Utility: Useful for making smaller plants
  misc_feature (143)..(143): Xaa is any aa, unknown or other
MSRALSVVCVLLAISFVCARARQVPGESDEGKTTGHDDTTTMPMHAKAADQLPPKSVGDKKCIGGVAGVGGFAGVGGVAGVGGLGMPLIGGLGGIGKYGGIGGAAGIGGFHSIGGVGVLGGVGGGVGRSRRCWRGCWWSRWRXRSRWSWFRRCRWCWRWYW

SEQ ID NO: 6586 - DNA, 1536 bp, Arabidopsis thaliana
  misc_feature (1)..(1536): useful for making plants with modified plant phenotypes as described in USSN 12/139,269
  misc_feature (1)..(1536): Ceres CLONE ID no. 101255
  misc_feature (1)..(1536): Also known as  Ceres CDNA ID no. 23385118
  misc_feature (584)..(584): w is a or t/u
  misc_feature (585)..(585): r is g or a
  misc_feature (610)..(610): y is t/u or c
  misc_feature (1203)..(1203): s is g or c
  misc_feature (1304)..(1304): m is a or c
  misc_feature (1305)..(1305): s is g or c
aaaaagctttgccggagatttagcaaacacaaacacaaaaaacaaaaccaactcagacgaatgtgattttttcttcttgagtgaattgttgtaaaaaaatgatgatcggagaatctcatcgtggttttaatccaacggttcatattcctccatggccactttctgaagatctaacggtgtctgatatttacggaagtccagacggaggaagtagtatgatggaagctttggctgagttacaacgttatcttccgtcaaacgaaccggatccggattcagatccggatctctcgggtccggattcaccaatcgatgcttatacatgcgatcattttcggatgtatgagtttaaagtgagacgttgtgctcgtggccggagccatgattggacggagtgtccttacgctcatcccggagaaaaagctcgccgtcgtgatccgaggaagtttcattactccggtacggcgtgtcctgagtttcgtaaaggttgttgcaagagaggagacgcatgtgagttttctcatggtgtttttgagtgttggcttcacccggcgcgttaccggactcagccgtgtaaagacggwrgtaactgtcgccgtcgtgtttgttyctttgctcattcgccggatcagattagggttttgcctaatcaaagccctgatcgtgttgattcgttcgacgttttgtctcctacgattcgtagagcgtttcagttttcgatttctccgtcgtctaactcgccgccggtgagtccacgaggtgactcggactcgtcgtgttcgttactgagtcgttcactcgggtctaatctgggaaacgacgtcgttgcgtctctcaggaatctgcaacttaataaagtgaagtcttctctttcgtcgtcatacaacaatcaaatcggaggatacggatccggattcgggtcgcctcgtggatcggttttgggtcctggtttccgtagcttaccaactacaccgacccgacctggttttatgaacatttgggagaatggcttggaggaagaaccggcgatggaacgggtcgagtcgggtcgtgaactgcgagcgcagctgttcgagaagctgagcaaagagaattgcatgggtcggattgaaccggatccggatcagggagcgggtgatactcctgatgtcgggtgggtctctgacttggttatgtgattggaaccggattcgtaaaccggastgcctgaaatttcgttgataaagattaattaaaggattattatcggcatgggaggttttttaatggatctcttcttaggaaaagaggagatttctctgcamstttttttttttgtatatttattatttcctaatttcgtataatctctgttccataatcgatgattcgagggagattcctcagtgtataggagttgcttaggatttttcattatgatggattcactaatattgatattgttggttattgtttttttatatattatgatgtaagatgcaagtcgcaatgtaattattaaatatcttatgaatgaaatgagaatgtaaattattt

SEQ ID NO: 6587 - protein, 216 aa, Arabidopsis thaliana
  misc_feature (1)..(216): useful for making plants with modified plant phenotypes as described in USSN 12/139,269
  misc_feature (1)..(216): Utility: Useful for increasing chlorophyll and photosynthetic capacity
  misc_feature (1)..(216): Utility: Useful for making ornamental plants with modified leaves
  misc_feature (1)..(216): Utility: Useful for making plants tolerant to low nitrogen
MMIGESHRGFNPTVHIPPWPLSEDLTVSDIYGSPDGGSSMMEALAELQRYLPSNEPDPDSDPDLSGPDSPIDAYTCDHFRMYEFKVRRCARGRSHDWTECPYAHPGEKARRRDPRKFHYSGTRVLSFVKVVAREETHVSFLMVFLSVGFTRRVTGLSRVKTVVTVAVVFVSLLIRRIRLGFCLIKALIVLIRSTFCLLRFVERFSFRFLRRLTRRR

SEQ ID NO: 6588 - protein, 359 aa, Arabidopsis thaliana; identical to SEQ ID NO: 792
  misc_feature (1)..(359): useful for making plants with modified plant phenotypes as described in USSN 12/139,269
  misc_feature (1)..(359): Public GI no. 22531114
  misc_feature (1)..(359): Utility: Useful for increasing chlorophyll and photosynthetic capacity
  misc_feature (1)..(359): Utility: Useful for making ornamental plants with modified leaves
  misc_feature (1)..(359): Utility: Useful for making plants tolerant to low nitrogen

SEQ ID NO: 6589 - protein, 339 aa, Arabidopsis thaliana
  misc_feature (1)..(339): useful for making plants with modified plant phenotypes as described in USSN 12/139,269
  misc_feature (1)..(339): Public GI no. 60460512
  misc_feature (1)..(339): Utility: Useful for increasing chlorophyll and photosynthetic capacity
  misc_feature (1)..(339): Utility: Useful for making ornamental plants with modified leaves
  misc_feature (1)..(339): Utility: Useful for making plants tolerant to low nitrogen
MTTVYDPSHHLTSKKLCFKDLEIPPRKKQLHCCHNAAAMELPHHEARLHKYLPSNEDDDGTDDPYGTDHFRMYEFKVRRCTRSRSHDWTDCPFAHPGEKARRRDPTRYQYSSTICSDFRRGGGCPRGDDCEFAHGVFECWLHPTRYRTEACKDGKNCKRKVCFFAHSSRELRLLPESQPPYKNSDKNYNHCCLFCRSVTSSSSLSPTSTLLGLSHFSRSPSLSPPLSPLKHQQRTPRYGGDRISKFGTEMTSSYDDVLLKEVMSYLGTMNLSEVSSPMATTANTNIPWFDVSFKGAPSTVSPSGSGEYFNGGGDDEKNNGNGVVLDHDLDLGWVNELLM

SEQ ID NO: 6590 - protein, 349 aa, Glycine max; identical to SEQ ID NO: 3189
  misc_feature (1)..(349): useful for making plants with modified plant phenotypes as described in USSN 12/139,269
  misc_feature (1)..(349): Ceres CLONE ID no. 673872
  misc_feature (1)..(349): Utility: Useful for increasing chlorophyll and photosynthetic capacity
  misc_feature (1)..(349): Utility: Useful for making ornamental plants with modified leaves
  misc_feature (1)..(349): Utility: Useful for making plants tolerant to low nitrogen

SEQ ID NO: 6591 - protein, 386 aa, Glycine max; identical to SEQ ID NO: 821
  misc_feature (1)..(386): useful for making plants with modified plant phenotypes as described in USSN 12/139,269
  misc_feature (1)..(386): Public GI no. 34906436
  misc_feature (1)..(386): Utility: Useful for increasing chlorophyll and photosynthetic capacity
  misc_feature (1)..(386): Utility: Useful for making ornamental plants with modified leaves
  misc_feature (1)..(386): Utility: Useful for making plants tolerant to low nitrogen

SEQ ID NO: 6592 - protein, 307 aa, Glycine max; identical to SEQ ID NO: 799
  misc_feature (1)..(307): useful for making plants with modified plant phenotypes as described in USSN 12/139,269
  misc_feature (1)..(307): Public GI no. 56605376
  misc_feature (1)..(307): Utility: Useful for increasing chlorophyll and photosynthetic capacity
  misc_feature (1)..(307): Utility: Useful for making ornamental plants with modified leaves
  misc_feature (1)..(307): Utility: Useful for making plants tolerant to low nitrogen

SEQ ID NO: 6593 - protein, 246 aa, Glycine max
  misc_feature (1)..(246): useful for making plants with modified plant phenotypes as described in USSN 12/139,269
  misc_feature (1)..(246): Public GI no. 38260609
  misc_feature (1)..(246): Utility: Useful for increasing chlorophyll and photosynthetic capacity
  misc_feature (1)..(246): Utility: Useful for making ornamental plants with modified leaves
  misc_feature (1)..(246): Utility: Useful for making plants tolerant to low nitrogen
MLKSVNPMAFYELGEQQFPTLGYIVSKPGNAGAYEIDPPIPSVDDAIYGSDEFRMYAYKIKRCPRTRSHDWTECPYAHRGEKATRRDPRRYSYCAVACPAFRNGACHRGDTCEFAHGVFEYWLHPARYRTRACNAGNLCQRKVCFFAHAPEQLRQSEGKHRCRYAYRPVRTTAARGRNGDGVGMRLDGDDFDTWQSPVKSGKSDLDINEERVLKCWSGISIVDDHYEPSDLDLDLSHIDWISELVD

SEQ ID NO: 6594 - DNA, 935 bp, Arabidopsis thaliana
  misc_feature (1)..(935): useful for making plants with modified plant phenotypes as described in USSN 12/139,269
  misc_feature (1)..(935): Ceres CLONE ID no. 103581
  misc_feature (1)..(935): Also known as  Ceres CDNA ID no. 23462890
ctctttcgctttctctcttctctcccattaccctctctctcgttttctcatactctcaactaaatatgccgtcggaaccaaaccaaacccgacccaccagagttcagccctcaacggcggcttacccaccgccaaatctggctgagccacttccttgtcctcgctgcaactccaccaccaccaagttctgttactacaacaactacaacctcgctcagcctcgttactactgcaaatcttgccgccgttactggactcaaggtggtacactccgtgacgtccccgtcggtggtggaactcgtcgtagctcctcaaaacgtcaccgctctttctccaccaccgtaacttcctcttcctcatcttcttccgtcatcacctccacgacacaagaaccagccacgactgaagcgagtcagattaaggttagtaatgtaacttcaggtcatggaagctttgcttctctgttgggtttaggaagtggaaatggtgggctggattacgggtttgggtacgggtacgggcttgaggatatgagtattgggtatcttggagattcttccgtaggagagattccggtggttgatggttgtggttgacacgtggcagattggggagattgaaggtaaaagtggaggagacagtttgatatggcctggtcttgagatctcaatgcaaaccaacgatgttaagtgaaaatgaaaccgtttctgatttcttgcctttgtcttcttttgttggtgtctttttggaaatttctgtttgttttcttttttgtcctagaaagaagagcaaaagaaaccaaattgaagcaagaatgtttttatttattttagtttttgaggtccaacaattctggtgtataaatcctctgtttatgtgacgaacatattggaatggatttatgagtaaaaatgtaaaaacatttctttcttttc

SEQ ID NO: 6595 - protein, 176 aa, Arabidopsis thaliana
  misc_feature (1)..(176): useful for making plants with modified plant phenotypes as described in USSN 12/139,269
  misc_feature (24)..(86): Pfam Name: zf-Dof; Pfam Description: Dof domain, zinc finger
  misc_feature (1)..(176): Utility: Useful for increasing chlorophyll and photosynthetic capacity
  misc_feature (1)..(176): Utility: Useful for increasing seed/fruit yield or modifying fruit content
  misc_feature (1)..(176): Utility: Useful for making plants sterile and for genetic confinement
  misc_feature (1)..(176): Utility: Useful for making plants with altered leaf shape eg curled leaves
  misc_feature (1)..(176): Utility: Useful for making plants with increased biomass and foliage
  misc_feature (1)..(176): Utility: Useful for making smaller plants
MPSEPNQTRPTRVQPSTAAYPPPNLAEPLPCPRCNSTTTKFCYYNNYNLAQPRYYCKSCRRYWTQGGTLRDVPVGGGTRRSSSKRHRSFSTTVTSSSSSSSVITSTTQEPATTEASQIKVSNVTSGHGSFASLLGLGSGNGGLDYGFGYGYGLEDMSIGYLGDSSVGEIPVVDGCG

SEQ ID NO: 6596 - protein, 209 aa, Arabidopsis thaliana
  misc_feature (1)..(209): useful for making plants with modified plant phenotypes as described in USSN 12/139,269
  misc_feature (1)..(209): Public GI no. 5668794
  misc_feature (1)..(209): Utility: Useful for increasing chlorophyll and photosynthetic capacity
  misc_feature (1)..(209): Utility: Useful for increasing seed/fruit yield or modifying fruit content
  misc_feature (1)..(209): Utility: Useful for making plants sterile and for genetic confinement
  misc_feature (1)..(209): Utility: Useful for making plants with altered leaf shape eg curled leaves
  misc_feature (1)..(209): Utility: Useful for making plants with increased biomass and foliage
  misc_feature (1)..(209): Utility: Useful for making smaller plants
MPSEPNQTRPTRVQPSTAAYPPPNLAEPLPCPRCNSTTTKFCYYNNYNLAQPRYYCKSCRRYWTQGGTLRDVPVGGGTRRSSSKRHRSFSTTATSSSSSSSVITTTTQEPATTEASQTKVTNLISGHGSFASLLGLGSGNGGLDYGFGYGYGLEEMSIGYLGDSSVGEIPVVDGCGGDTWQIGEIEGKSGGDSLIWPGLEISMQTNDVK

SEQ ID NO: 6597 - protein, 99 aa, Brassica napus
  misc_feature (1)..(99): useful for making plants with modified plant phenotypes as described in USSN 12/139,269
  misc_feature (1)..(99): Ceres CLONE ID no. 978708
  misc_feature (1)..(99): Utility: Useful for increasing chlorophyll and photosynthetic capacity
  misc_feature (1)..(99): Utility: Useful for increasing seed/fruit yield or modifying fruit content
  misc_feature (1)..(99): Utility: Useful for making plants sterile and for genetic confinement
  misc_feature (1)..(99): Utility: Useful for making plants with altered leaf shape eg curled leaves
  misc_feature (1)..(99): Utility: Useful for making plants with increased biomass and foliage
  misc_feature (1)..(99): Utility: Useful for making smaller plants
MIMTAKQQQQPELPEQEQLNCPRCASPNTKFCYYNNYNLSQPRHFCKNCRRYWTKGGSLRNIPVGGGTRKNSSKRSSVGSSSSAPSSSSPKSKTVAVSD

SEQ ID NO: 6598 - protein, 118 aa, Triticum aestivum
  misc_feature (1)..(118): useful for making plants with modified plant phenotypes as described in USSN 12/139,269
  misc_feature (1)..(118): Ceres CLONE ID no. 678544
  misc_feature (1)..(118): Utility: Useful for increasing chlorophyll and photosynthetic capacity
  misc_feature (1)..(118): Utility: Useful for increasing seed/fruit yield or modifying fruit content
  misc_feature (1)..(118): Utility: Useful for making plants sterile and for genetic confinement
  misc_feature (1)..(118): Utility: Useful for making plants with altered leaf shape eg curled leaves
  misc_feature (1)..(118): Utility: Useful for making plants with increased biomass and foliage
  misc_feature (1)..(118): Utility: Useful for making smaller plants
  misc_feature (96)..(96): Xaa is any aa, unknown or other
MLMGAPSANQQVQGSNPNPPAQAPSSAPGAGGPMRGGTPAMAVAGSGAGAGSTERRPRPQKEKAINCPRCNSTNTKFCYYNNYSLQQPRYFCKTCXRYWTEGGSLRNVPVGGGSRKNK

SEQ ID NO: 6599 - protein, 301 aa, Zea mays
  misc_feature (1)..(301): useful for making plants with modified plant phenotypes as described in USSN 12/139,269
  misc_feature (1)..(301): Ceres CLONE ID no. 324937
  misc_feature (1)..(301): Utility: Useful for increasing chlorophyll and photosynthetic capacity
  misc_feature (1)..(301): Utility: Useful for increasing seed/fruit yield or modifying fruit content
  misc_feature (1)..(301): Utility: Useful for making plants sterile and for genetic confinement
  misc_feature (1)..(301): Utility: Useful for making plants with altered leaf shape eg curled leaves
  misc_feature (1)..(301): Utility: Useful for making plants with increased biomass and foliage
  misc_feature (1)..(301): Utility: Useful for making smaller plants
  misc_feature (288)..(288): Xaa is any aa, unknown or other
MEEMLMAGNANPNPPPAAAPSAPGAQTQSQRGGGAPPPAAGAAAPSAGATVGAAGTERRARPHKEKALNCPRCNSTNTKFCYYNNYSLQQPRYFCKTCRRYWTEGGSLRNVPVGGGSRKNKRSSSSAASTSAAMSGTVSVKNPKLVHEGAHHDLNLAFPHHNNGRALQPPEFPSSFPNLESSSVCYPGAAMLGNGAAGRGMGALSAMELLRSTGCYVPLQHVQLGMPAEYAAPAGFTLGEFRIPPPPQSQSVLGFSLDTHGTGGYSAGGLQESAVGRMLFPFEDLKPXGERSWRRCKQRRS

SEQ ID NO: 6600 - protein, 250 aa, Zea mays
  misc_feature (1)..(250): useful for making plants with modified plant phenotypes as described in USSN 12/139,269
  misc_feature (1)..(250): Ceres CLONE ID no. 300623
  misc_feature (1)..(250): Utility: Useful for increasing chlorophyll and photosynthetic capacity
  misc_feature (1)..(250): Utility: Useful for increasing seed/fruit yield or modifying fruit content
  misc_feature (1)..(250): Utility: Useful for making plants sterile and for genetic confinement
  misc_feature (1)..(250): Utility: Useful for making plants with altered leaf shape eg curled leaves
  misc_feature (1)..(250): Utility: Useful for making plants with increased biomass and foliage
  misc_feature (1)..(250): Utility: Useful for making smaller plants
MPSSFLTSSSSSASSHLSYLIPARAAAPPPFAMGQGYGATSGGGVANATSAAAAPPPPRQGASRNAGAGHPPLPRPPPRQCPRCRSANTKFCYYNNYSREQPRYLCKACRRHWTEGGTLRDVPVGGGRKNRRGAKGGADAKGSASAAAAAPAQQGGNVVLGADTFPGDLLRQLVQFQPDAAVGGGGYAIDLSAWHQMVAATVPPPPPPGTGGDVSSLGLGAAGAGAGAEANCVALQYWSEDGMPGLDGPC

SEQ ID NO: 6601 - protein, 106 aa, Brassica napus
  misc_feature (1)..(106): useful for making plants with modified plant phenotypes as described in USSN 12/139,269
  misc_feature (1)..(106): Ceres CLONE ID no. 1068780
  misc_feature (1)..(106): Utility: Useful for increasing chlorophyll and photosynthetic capacity
  misc_feature (1)..(106): Utility: Useful for increasing seed/fruit yield or modifying fruit content
  misc_feature (1)..(106): Utility: Useful for making plants sterile and for genetic confinement
  misc_feature (1)..(106): Utility: Useful for making plants with altered leaf shape eg curled leaves
  misc_feature (1)..(106): Utility: Useful for making plants with increased biomass and foliage
  misc_feature (1)..(106): Utility: Useful for making smaller plants
MLMMAAKQQQQPELPEQQQLKCPRCDSPNTKFCYYNNYNLSQPRHYCKNCRRYWTKGGSLRNIPVGGGSRKNTKRSSSSSPSSSNLKDKTVAVPDQKPNSEEESRP

SEQ ID NO: 6602 - protein, 378 aa, Brassica napus
  misc_feature (1)..(378): useful for making plants with modified plant phenotypes as described in USSN 12/139,269
  misc_feature (1)..(378): Public GI no. 4996640
  misc_feature (1)..(378): Utility: Useful for increasing chlorophyll and photosynthetic capacity
  misc_feature (1)..(378): Utility: Useful for increasing seed/fruit yield or modifying fruit content
  misc_feature (1)..(378): Utility: Useful for making plants sterile and for genetic confinement
  misc_feature (1)..(378): Utility: Useful for making plants with altered leaf shape eg curled leaves
  misc_feature (1)..(378): Utility: Useful for making plants with increased biomass and foliage
  misc_feature (1)..(378): Utility: Useful for making smaller plants
MDAAHWHQGLGLVKPMEEMLMAANAAAGANPNPAATAPSSVTGGALRGGGGGGAPPVAGGAGAGSTERRARPQKEKALNCPRCNSTNTKFCYYNNYSLQQPRYFCKTCRRYWTEGGSLRNVPVGGGSRKNKRSSSSAASASPASASTANSVVTSASMSMSMASTGGGASKNPKLVHEGAQDLNLAFPHHGGLQAPGEFPAFPSLESSSVCNPGGPMGTNGRGGGALSAMELLRSTGCYMPLQVPMQMPAEYATPGFALGEFRAPPPPPQSSQSLLGFSLDAHGSVGGPSAAGFGSSAGLQGVPESTGRLLFPFEDLKPTVSSGTGGGGASGGGAGVDGGHQFDHGKEQQAGGGGGGPGGHDTPGFWNGMIGGGSGTSW

SEQ ID NO: 6603 - protein, 360 aa, Brassica napus
  misc_feature (1)..(360): useful for making plants with modified plant phenotypes as described in USSN 12/139,269
  misc_feature (1)..(360): Public GI no. 50928017
  misc_feature (1)..(360): Utility: Useful for increasing chlorophyll and photosynthetic capacity
  misc_feature (1)..(360): Utility: Useful for increasing seed/fruit yield or modifying fruit content
  misc_feature (1)..(360): Utility: Useful for making plants sterile and for genetic confinement
  misc_feature (1)..(360): Utility: Useful for making plants with altered leaf shape eg curled leaves
  misc_feature (1)..(360): Utility: Useful for making plants with increased biomass and foliage
  misc_feature (1)..(360): Utility: Useful for making smaller plants
MLMAANAAAGANPNPAATAPSSVTGGALRGGGGGGAPPVAGGAGAGSTERRARPQKEKALNCPRCNSTNTKFCYYNNYSLQQPRYFCKTCRRYWTEGGSLRNVPVGGGSRKNKRSSSSAASASPASASTANSVVTSASMSMSMASTGGGASKNPKLVHEGAQDLNLAFPHHGGLQAPGEFPAFPSLESSSVCNPGGPMGTNGRGGGALSAMELLRSTGCYMPLQVPMQMPAEYATPGFALGEFRAPPPPPQSSQSLLGFSLDAHGSVGGPSAAGFGSSAGLQGVPESTGRLLFPFEDLKPTVSSGTGGGGASGGGAGVDGGHQFDHGKEQQAGGGGGGPGGHDTPGFWNGMIGGGSGTSW

SEQ ID NO: 6604 - protein, 262 aa, Brassica napus; identical to SEQ ID NO: 65
  misc_feature (1)..(262): useful for making plants with modified plant phenotypes as described in USSN 12/139,269
  misc_feature (1)..(262): Public GI no. 3341468
  misc_feature (1)..(262): Utility: Useful for increasing chlorophyll and photosynthetic capacity
  misc_feature (1)..(262): Utility: Useful for increasing seed/fruit yield or modifying fruit content
  misc_feature (1)..(262): Utility: Useful for making plants sterile and for genetic confinement
  misc_feature (1)..(262): Utility: Useful for making plants with altered leaf shape eg curled leaves
  misc_feature (1)..(262): Utility: Useful for making plants with increased biomass and foliage
  misc_feature (1)..(262): Utility: Useful for making smaller plants
  misc_feature (218)..(218): Xaa is any aa, unknown or other

SEQ ID NO: 6605 - protein, 234 aa, Brassica napus
  misc_feature (1)..(234): useful for making plants with modified plant phenotypes as described in USSN 12/139,269
  misc_feature (1)..(234): Public GI no. 1360078
  misc_feature (1)..(234): Utility: Useful for increasing chlorophyll and photosynthetic capacity
  misc_feature (1)..(234): Utility: Useful for increasing seed/fruit yield or modifying fruit content
  misc_feature (1)..(234): Utility: Useful for making plants sterile and for genetic confinement
  misc_feature (1)..(234): Utility: Useful for making plants with altered leaf shape eg curled leaves
  misc_feature (1)..(234): Utility: Useful for making plants with increased biomass and foliage
  misc_feature (1)..(234): Utility: Useful for making smaller plants
LPLPFFNMDTSHWPQGIGLAKAVEPSKPVPVTERKPRPQKEQAINCPRCNSTNTKFCYYNNYSLSQPRYFCKTCRRYWTDGGSLRNVPVGGGSRKNKRSNSSSNNSSSSTSSSYKKIPDLTIPTSSSTQNPKIINEPHDLNLTFNPSTTSNFSNISEFMALPLMNPNSTTSFMSSIMPQISDSNNIMYSSSSTGLPNLHDLKPTLNFSLDGFDNNNGYGSLQGETAGAKLFFPL

SEQ ID NO: 6606 - protein, 234 aa, Brassica napus; identical to SEQ ID NO: 64
  misc_feature (1)..(234): useful for making plants with modified plant phenotypes as described in USSN 12/139,269
  misc_feature (1)..(234): Public GI no. 37051131
  misc_feature (1)..(234): Utility: Useful for increasing chlorophyll and photosynthetic capacity
  misc_feature (1)..(234): Utility: Useful for increasing seed/fruit yield or modifying fruit content
  misc_feature (1)..(234): Utility: Useful for making plants sterile and for genetic confinement
  misc_feature (1)..(234): Utility: Useful for making plants with altered leaf shape eg curled leaves
  misc_feature (1)..(234): Utility: Useful for making plants with increased biomass and foliage
  misc_feature (1)..(234): Utility: Useful for making smaller plants

SEQ ID NO: 6607 - protein, 236 aa, Glycine max
  misc_feature (1)..(236): useful for making plants with modified plant phenotypes as described in USSN 12/139,269
  misc_feature (1)..(236): Ceres CLONE ID no. 666382
  misc_feature (1)..(236): Utility: Useful for increasing chlorophyll and photosynthetic capacity
  misc_feature (1)..(236): Utility: Useful for increasing seed/fruit yield or modifying fruit content
  misc_feature (1)..(236): Utility: Useful for making plants sterile and for genetic confinement
  misc_feature (1)..(236): Utility: Useful for making plants with altered leaf shape eg curled leaves
  misc_feature (1)..(236): Utility: Useful for making plants with increased biomass and foliage
  misc_feature (1)..(236): Utility: Useful for making smaller plants
MPSSNSGESRRASKPHRSVAAPPVEPENLPCPRCDSANTKFCYYNNYNYSQPRHFCKSCRRYWTHGGTLRDIPVGGGSRKNAKRSRTHHAAAATSSSSSTSSATTSAHEHHNAHTLTALAPVTAATHFGHDGDVKQTNGNACGSYTSLLNNTQGSGFFALGGFGLGLGHGFDDMGFGIGRSGWAFPGMVDNGNIGGAIASSGVNTWQLESGEGGFVGGDCFSWPGLAISTPGNGLK

SEQ ID NO: 6608 - protein, 378 aa, Triticum aestivum
  misc_feature (1)..(378): useful for making plants with modified plant phenotypes as described in USSN 12/139,269
  misc_feature (1)..(378): Ceres CLONE ID no. 738478
  misc_feature (1)..(378): Utility: Useful for increasing chlorophyll and photosynthetic capacity
  misc_feature (1)..(378): Utility: Useful for increasing seed/fruit yield or modifying fruit content
  misc_feature (1)..(378): Utility: Useful for making plants sterile and for genetic confinement
  misc_feature (1)..(378): Utility: Useful for making plants with altered leaf shape eg curled leaves
  misc_feature (1)..(378): Utility: Useful for making plants with increased biomass and foliage
  misc_feature (1)..(378): Utility: Useful for making smaller plants
MDAAHWPQGLGLVKPMEEMLMGAPSSNQQVQGSNPNPPAQAPSSAPGAGGPMRGGTPAMAVAASGVGAGSTERRPRPQKEKAINCPRCNSTNTKFCYYNNYSLQQPRYFCKTCRRYWTEGGSLRNVPVGGGSRKNKRSSSSSASASASAAASATASVANSSMLGAAPNKNPKLAHEGAAHDLNLAFPHHQGGMQAQADYMAFPSLESSSMCNPGGGGMAANGARAGGALSAMELLRSTGCYMPLQMPMQMPGEYGAAGFSLGEFRAPAPPQSQSLLGFSLDAHGSVGGASMAGYGSGAGMQGMQDRSGRLLFAFEDLKPTANSGAGGGESGGGSGAGVDGGDHQFEQGNKEQQGNGTPVGQPDTPGFWNGMIGGGGTW

SEQ ID NO: 6609 - DNA, 693 bp, Arabidopsis thaliana
  misc_feature (1)..(693): useful for making plants with modified plant phenotypes as described in USSN 12/139,269
  misc_feature (1)..(693): Ceres CLONE ID no. 109514
  misc_feature (1)..(693): Also known as  Ceres CDNA ID no. 23358577
acacaaactaaaaaaccgatcatagaaaggaaaaaaaaaatcaaaaccctagaagtcactaagtcgattcaaaatggttgcgagaagtgaggaaattgtgatagtggaagaagatacgactgcgaaatgtttgatgttgttatcaagagtcggagaatgcggcggcggctgcgggggagatgaacgtgttttccgatgcaagacttgtcttaaagagttctcatcgtttcaagctttgggaggtcatcgtgcaagccacaagaaacttatcaacagtgacaatccatcacttcttggatccttgtccaacaagaagactaaaacgtctcatccttgtccgatatgtggcgtgaaatttccgatgggacaagctcttggtggtcacatgaggagacataggaacgagaaagcctcaagcatgttggttacacgttcttttctaccggagacgacgacggtgacggctttgaagaaatttagtagtgggaagagagtggcttgtttggatttcgacttagattcggtggagtgtttggtcaattggaagttggagttgggaagaacgatttcttggtgttaggtttcttggttttatagatttacatattgtatacagtttcacatgattttgtaatctctgttgatccaattatcgtaccgatcgatgtgaatattattttgatacaatatccg

SEQ ID NO: 6610 - protein, 168 aa, Arabidopsis thaliana
  misc_feature (1)..(168): useful for making plants with modified plant phenotypes as described in USSN 12/139,269
  misc_feature (86)..(108): Pfam Name: zf-C2H2; Pfam Description: Zinc finger, C2H2 type
  misc_feature (1)..(168): Utility: Useful for increasing chlorophyll and photosynthetic capacity
  misc_feature (1)..(168): Utility: Useful for making ornamental plants with modified leaves
  misc_feature (1)..(168): Utility: Useful for making plants with altered leaf shape eg curled leaves
  misc_feature (1)..(168): Utility: Useful for modifying fruit shape, composition and seed yield
MVARSEEIVIVEEDTTAKCLMLLSRVGECGGGCGGDERVFRCKTCLKEFSSFQALGGHRASHKKLINSDNPSLLGSLSNKKTKTSHPCPICGVKFPMGQALGGHMRRHRNEKASSMLVTRSFLPETTTVTALKKFSSGKRVACLDFDLDSVECLVNWKLELGRTISWC

SEQ ID NO: 6611 - protein, 164 aa, Arabidopsis thaliana
  misc_feature (1)..(164): useful for making plants with modified plant phenotypes as described in USSN 12/139,269
  misc_feature (1)..(164): Public GI no. 7798996
  misc_feature (1)..(164): Utility: Useful for increasing chlorophyll and photosynthetic capacity
  misc_feature (1)..(164): Utility: Useful for making ornamental plants with modified leaves
  misc_feature (1)..(164): Utility: Useful for making plants with altered leaf shape eg curled leaves
  misc_feature (1)..(164): Utility: Useful for modifying fruit shape, composition and seed yield
MVARSEEVEIVEDTAAKCLMLLSRVGECGGGGEKRVFRCKTCLKEFSSFQALGGHRASHKKLINSSDPSLLGSLSNKKTKTATSHPCPICGVEFPMGQALGGHMRRHRSEKASPGTLVTRSFLPETTTVTTLKKSSSGKRVACLDLDSMESLVNWKLELGRTIS

SEQ ID NO: 6612 - protein, 153 aa, Parthenium argentatum; identical to SEQ ID NO: 1140
  misc_feature (1)..(153): useful for making plants with modified plant phenotypes as described in USSN 12/139,269
  misc_feature (1)..(153): Ceres CLONE ID no. 1608104
  misc_feature (1)..(153): Utility: Useful for increasing chlorophyll and photosynthetic capacity
  misc_feature (1)..(153): Utility: Useful for making ornamental plants with modified leaves
  misc_feature (1)..(153): Utility: Useful for making plants with altered leaf shape eg curled leaves
  misc_feature (1)..(153): Utility: Useful for modifying fruit shape, composition and seed yield

SEQ ID NO: 6613 - protein, 174 aa, Parthenium argentatum; identical to SEQ ID NO: 1134
  misc_feature (1)..(174): useful for making plants with modified plant phenotypes as described in USSN 12/139,269
  misc_feature (1)..(174): Public GI no. 2346974
  misc_feature (1)..(174): Utility: Useful for increasing chlorophyll and photosynthetic capacity
  misc_feature (1)..(174): Utility: Useful for making ornamental plants with modified leaves
  misc_feature (1)..(174): Utility: Useful for making plants with altered leaf shape eg curled leaves
  misc_feature (1)..(174): Utility: Useful for modifying fruit shape, composition and seed yield

SEQ ID NO: 6614 - protein, 159 aa, Parthenium argentatum
  misc_feature (1)..(159): useful for making plants with modified plant phenotypes as described in USSN 12/139,269
  misc_feature (1)..(159): Public GI no. 34908122
  misc_feature (1)..(159): Utility: Useful for increasing chlorophyll and photosynthetic capacity
  misc_feature (1)..(159): Utility: Useful for making ornamental plants with modified leaves
  misc_feature (1)..(159): Utility: Useful for making plants with altered leaf shape eg curled leaves
  misc_feature (1)..(159): Utility: Useful for modifying fruit shape, composition and seed yield
MESLRVHASALLSLSSPAASASQPTSSSSTTEGVFECKTCSKRFPSFQALGGHRTSHTRLQAKLLSDPAAAAAAAAERDRARVHECAVCGVEFSMGQALGGHMRRHRGETGTTTVVLADADDSGGATVPQPPEPMPDLNYPPLEDAGDGSEPELLNLLV

SEQ ID NO: 6615 - protein, 178 aa, Parthenium argentatum
  misc_feature (1)..(178): useful for making plants with modified plant phenotypes as described in USSN 12/139,269
  misc_feature (1)..(178): Public GI no. 55734104
  misc_feature (1)..(178): Utility: Useful for increasing chlorophyll and photosynthetic capacity
  misc_feature (1)..(178): Utility: Useful for making ornamental plants with modified leaves
  misc_feature (1)..(178): Utility: Useful for making plants with altered leaf shape eg curled leaves
  misc_feature (1)..(178): Utility: Useful for modifying fruit shape, composition and seed yield
MGVKRFREEQSANCLMLLSKVGLLSEMEKSAVPALKPGAGGRIYECKTCKKQFLTFQALGGHRASHKKLRLMAADLLHQSLAVTKPKTHACSICGLEFPLGQALGGHMRRHRGAALDGEKPVVVSDKPVAKAVPFLMRSNSSKRIFGFEVDGLDLNLTPEDNDPDERDKFPPLLEFFV

SEQ ID NO: 6616 - protein, 214 aa, Triticum aestivum
  misc_feature (1)..(214): useful for making plants with modified plant phenotypes as described in USSN 12/139,269
  misc_feature (1)..(214): Ceres CLONE ID no. 569852
  misc_feature (1)..(214): Utility: Useful for increasing chlorophyll and photosynthetic capacity
  misc_feature (1)..(214): Utility: Useful for making ornamental plants with modified leaves
  misc_feature (1)..(214): Utility: Useful for making plants with altered leaf shape eg curled leaves
  misc_feature (1)..(214): Utility: Useful for modifying fruit shape, composition and seed yield
IQTHPSQKHLAISVPSPSFVSVVFRSSALLFGLMAHGKRSRQQAESTSVSLLDLDSGDMARILLLFSGHHQHHAHYGPSSPERVFECKTCNRRFPSFQALGGHRASHKKPRLADGAGAEPPKPKVHGCSICGLEFAVGQALGGHMRRHRAVAAAGPGVGLGLSLGLGLGPNEDGNKKAAAAAELALDLNEPALEEEPADRAMLGLAVGFRPRGG

SEQ ID NO: 6617 - protein, 175 aa, Triticum aestivum
  misc_feature (1)..(175): useful for making plants with modified plant phenotypes as described in USSN 12/139,269
  misc_feature (1)..(175): Public GI no. 2346976
  misc_feature (1)..(175): Utility: Useful for increasing chlorophyll and photosynthetic capacity
  misc_feature (1)..(175): Utility: Useful for making ornamental plants with modified leaves
  misc_feature (1)..(175): Utility: Useful for making plants with altered leaf shape eg curled leaves
  misc_feature (1)..(175): Utility: Useful for modifying fruit shape, composition and seed yield
MSSIKRSRSEEYGQVEAEAMANCLMLLSKLNDHNTSKNQDHHNEFECKTCNKRFPSFQALGGHRASHKRTKVLTGAGEFLAQQAKKNKMHECSICGMEFSLGQALGGHMRRHRDENNKTLKVARKTTTMIPVLKKSNSSKRIFCLDLNLTPRNEDVDLKLWPTAPISSPVLRIFI

SEQ ID NO: 6618 - protein, 215 aa, Glycine max
  misc_feature (1)..(215): useful for making plants with modified plant phenotypes as described in USSN 12/139,269
  misc_feature (1)..(215): Ceres CLONE ID no. 603406
  misc_feature (1)..(215): Utility: Useful for increasing chlorophyll and photosynthetic capacity
  misc_feature (1)..(215): Utility: Useful for making ornamental plants with modified leaves
  misc_feature (1)..(215): Utility: Useful for making plants with altered leaf shape eg curled leaves
  misc_feature (1)..(215): Utility: Useful for modifying fruit shape, composition and seed yield
SNNFVPFQSLCPFSYIHIFILPHLKTKHPAIFQFLFWLVVMKREREVDSLTMANCLMLLSRGSEFEATYSSTSMSNRVFECKTCNRQFPSFQALGGHRASHKKPRLMAGDIEGQLLHDSPPKPKTHECSICGLEFAIGQALGGHMRRHRAANLNGNVHNSTATSSSSGGSSFDSSPKKKADNKRVLVLDLNLTPFENDLEFLKIGKPTTFVDYLY

SEQ ID NO: 6619 - DNA, 1999 bp, Arabidopsis thaliana
  misc_feature (1)..(1999): useful for making plants with modified plant phenotypes as described in USSN 12/139,269
  misc_feature (1)..(1999): Ceres CLONE ID no. 115946
  misc_feature (1)..(1999): Also known as  Ceres CDNA ID no. 23363175
agcaaggttactgcaaggttaaagcgggaagtgagcaacgagaggcagcggcggccgtcatggattcatcggcgaacataaacaaagctctaacggagacgcgtttctccgacctcgaacctccactctccggagatatcattgaggctcttaatcagtctgatttcgagttctgcactccggttcaagccgcgacgatccctttactctgtagttacaaggatgttgccgtcgacgctgccactggttctggaaaaaccctagctttcgtcgttcccctcgtagaaatcctccgtcgatccacctcattccctccgaagcctcaccaggtcatgggggtgattatatcgccaacgagagagctatcaacgcagatatataatgtcgcacaaccatttgtttcgactttggcaaatgtgaactctgtgttgcttgttggaggccgagaggtgaaagctgacatgaagattattgaagaagaaggatgcaatgtcttgattggtacacctggaagactttctgatattatggaacgaatggagattctggattttcgaaatcttgagattcttattctagatgaggcagataggcttttggagatggggttccaaaggcaggtgaattacattatctcacgcttgccaaagcagaggaggactggcctcttttcagctacacaaacagagggcgttgaagagctcgccaaggctgggcttaggaaccctgtgagagttgaagttcgagctaagtcgaagtcggaatcatcccagcaattgacaaactcgaaaaccccttctggtcttcatcttgagtatatggaatgcgaagcagataaaaaatcatcacaactagttgatctcctcatcaagaacagtgataaaaagcttatagtattcttcatgacctgtgcttctgttgactactggggactcgtactttcaaaaattcctgccctgaagtccatatctttaattcctatccatggggatatgaagcagaatgcaagagacaaggcattagcttcgtttactaaagcatcaagtggtgcccttctgtgcacagacgttgctgcacgtggacttgatattccaggcattgattatgttgttcagtatgatcccccacaagacccaaatatgttcaaccacagggccggcagaactgcaagattaggaagacaagggagggccattgtgtttttactgcccaaggaagaagcctatgtagagtttatgcgcataagaagagtccctttggaagagagaaaatgctctgaggacgcatccgatgtcatcccgattatacgttcagctgccatgaaggaccgagcagtgatggagaagggattaaaggcatttgtttcctttgtccgtgcttataaggagcatcactgctctttcattttcagatggaaagaccttgagattggaaagttagccatgggatatggcctcttgtatcttccttcaatgtctgaagttaaacaacacagactttccagtgagggtttcacaccagttgaaggtgtcaagtttgaagaaataaaattcaaggacaaatatcgggagaaacaaagacagcaaaacttacaagtaaggaaagagaaacggcaagaagagaaaaaagagaaaggcaagagaaaaagggttgatgcttctgctagtaatgatcctaagaaagcgtcgagaaagttaacggggaaacaaagacaaactattcaaactgctgaagatgaagaagtgatggatcgagattataagttgatgataaaagtaaagaaagggttaattaaagaagatgaatatgaaagacttacaggagatgatgatttattctgatgagaagaaacaaaacctgcatgctgagattggactaagcttagtgtctttctactctcatatcatatgtgattctgttaattttttttttttttttgggtgagaattaatatcggatcatgttatgtcctttttcgttctacgagtctcacttttat

SEQ ID NO: 6620 - protein, 612 aa, Arabidopsis thaliana
  misc_feature (1)..(612): useful for making plants with modified plant phenotypes as described in USSN 12/139,269
  misc_feature (58)..(234): Pfam Name: DEAD; Pfam Description: DEAD/DEAH box helicase
  misc_feature (316)..(392): Pfam Name: Helicase_C; Pfam Description: Helicase conserved C-terminal domain
  misc_feature (1)..(612): Utility: Useful for increasing chlorophyll and photosynthetic capacity
  misc_feature (1)..(612): Utility: Useful for making plants with increased biomass and foliage
  misc_feature (1)..(612): Utility: Useful for making shorter plants and plants with modified flowers
  misc_feature (1)..(612): Utility: Useful for modifying plant structure, ie increased branching
QGYCKVKAGSEQREAAAAVMDSSANINKALTETRFSDLEPPLSGDIIEALNQSDFEFCTPVQAATIPLLCSYKDVAVDAATGSGKTLAFVVPLVEILRRSTSFPPKPHQVMGVIISPTRELSTQIYNVAQPFVSTLANVNSVLLVGGREVKADMKIIEEEGCNVLIGTPGRLSDIMERMEILDFRNLEILILDEADRLLEMGFQRQVNYIISRLPKQRRTGLFSATQTEGVEELAKAGLRNPVRVEVRAKSKSESSQQLTNSKTPSGLHLEYMECEADKKSSQLVDLLIKNSDKKLIVFFMTCASVDYWGLVLSKIPALKSISLIPIHGDMKQNARDKALASFTKASSGALLCTDVAARGLDIPGIDYVVQYDPPQDPNMFNHRAGRTARLGRQGRAIVFLLPKEEAYVEFMRIRRVPLEERKCSEDASDVIPIIRSAAMKDRAVMEKGLKAFVSFVRAYKEHHCSFIFRWKDLEIGKLAMGYGLLYLPSMSEVKQHRLSSEGFTPVEGVKFEEIKFKDKYREKQRQQNLQVRKEKRQEEKKEKGKRKRVDASASNDPKKASRKLTGKQRQTIQTAEDEEVMDRDYKLMIKVKKGLIKEDEYERLTGDDDLF

SEQ ID NO: 6621 - protein, 138 aa, Triticum aestivum
  misc_feature (1)..(138): useful for making plants with modified plant phenotypes as described in USSN 12/139,269
  misc_feature (1)..(138): Ceres CLONE ID no. 919325
  misc_feature (1)..(138): Utility: Useful for increasing chlorophyll and photosynthetic capacity
  misc_feature (1)..(138): Utility: Useful for making plants with increased biomass and foliage
  misc_feature (1)..(138): Utility: Useful for making shorter plants and plants with modified flowers
  misc_feature (1)..(138): Utility: Useful for modifying plant structure, ie increased branching
SPSPATAAARKRALTEQRFSELTPALSLEVVEALDRGGFRRCTPVQAATIPLLLTHKDVAVDAATGSGKTLAFVVPVVEMLRRLPSPPKPHQVLAIIISPTRELSSQIYNVAQPFFATLKGVSSILLVGGLDIKVELE

SEQ ID NO: 6622 - protein, 647 aa, Triticum aestivum
  misc_feature (1)..(647): useful for making plants with modified plant phenotypes as described in USSN 12/139,269
  misc_feature (1)..(647): Public GI no. 34896098
  misc_feature (1)..(647): Utility: Useful for increasing chlorophyll and photosynthetic capacity
  misc_feature (1)..(647): Utility: Useful for making plants with increased biomass and foliage
  misc_feature (1)..(647): Utility: Useful for making shorter plants and plants with modified flowers
  misc_feature (1)..(647): Utility: Useful for modifying plant structure, ie increased branching
MSSSSSSLAAAAARKRALTEQRFSELSPALSPEVVKALKGGGFRRCTPVQAAAIPLLLSHKDVAVDAATGSGKTLAFVVPVVEILRRRPSPPKPHEVLGIIISPTRELSSQIYNVAQPFFATLKGVSSMLLVGGFDIKAELKKLEEEGANILVGTPGKLFDVMERLDTLNYKNLEILILDEADRLLDLGFQKQITSIISKLPKLRRTGLFSATQTEAVKELAKAGLRNPVRVEVKTEVKPTGKDGAQQELGPSKTPLGLRLEYMICEASNKSSQLVDFLVQNNGKKIMVYFATCACVDYWAIVLPLLDSLKGSPIIPYHGKMKQGPREKALASFSALSSGILVCTDVAARGLDIPHVDLIVQYDPPQDPNVFIHRAGRTARYDQEGDAIVFLLPKEDTYVEFLKRRGVPLTERECSTNAVDIVPQIRSAALEDRNVMEKGLTAFVSFVRAYKEHHCSYIFSWKDLEIGRLGMEYGLLQIPSMPEVKHHSLSLEGFTPVKDVDVTKIKYKDKAREKQRQKTLKRKAEELALRPEIEKRRKAPEKPEKPKRKKTGKQRQAVQTKEDMDELANEYRLLKKLKRGVIDEDEYEKLTGFGESDDDDSSDGGDSDLDERKERGNKVLKKIKQKGKAKGSRRFEGRSKQKTRRR

SEQ ID NO: 6623 - protein, 486 aa, Zea mays
  misc_feature (1)..(486): useful for making plants with modified plant phenotypes as described in USSN 12/139,269
  misc_feature (1)..(486): Ceres CLONE ID no. 644693
  misc_feature (1)..(486): Utility: Useful for increasing chlorophyll and photosynthetic capacity
  misc_feature (1)..(486): Utility: Useful for making plants with increased biomass and foliage
  misc_feature (1)..(486): Utility: Useful for making shorter plants and plants with modified flowers
  misc_feature (1)..(486): Utility: Useful for modifying plant structure, ie increased branching
MPDIVVATPGRIIDHLRNSLSVGLEDLAVVILDEADRLLELGFSAEIQELIRMCPKRRQTMLFSATMTEEIDELIKLSLNKPVRLEADPSLKRPATLTEEVVRIRRARESNQEAVLLALCLKTFKRSVIIFSGTKQSAHRLKIIFGLSGMKAAELHGNLTQAQRLEALELFKKKEVDFLIATDVAARGIDIVGVQTVINFACPRDVKTYLHRVGRTARAGREGYAVTFVTDDDRCLLKAIAKKAGSQLKSRIVAEKPVAECARLIEQLEGQISIIIREERVEREARKAEMEIAKAENMIAHKDEIYSRPKRTWFATEREKKLLAAAAKESLDHGKSTSGVISAKKAEDLRLKEKRRREHEKNLPRKKRRRLEAQREMLEDEDDEKTKENDRGKQPMKGQSLVDAAYRKAKSLKAASKRAPGARKGKKEKNERQHSEKAPNRHEEMRDLFQNDMSEWKQGRSSKKNNKFAPKKSRNSFKSKARYKRK

SEQ ID NO: 6624 - DNA, 1244 bp, Arabidopsis thaliana
  misc_feature (1)..(1244): useful for making plants with modified plant phenotypes as described in USSN 12/139,269
  misc_feature (1)..(1244): Ceres CLONE ID no. 115975
  misc_feature (1)..(1244): Also known as  Ceres CDNA ID no. 23371428
  misc_feature (1193)..(1193): k is g or t/u
tcccaaacctatcttcttcttcctctcttgtctctctcgctctctctcttctacattgtttcttgaggtcaatccattaaaaatgggattatattcactaatcacaggaagaaaaggaccaagtggatttggttcagcttcaacagctgaagaggttactcaagggattgatgcaactaatctcactgcaattatcacaggagggacaggaggaatagggatggagacagcgagagtgctgtcgaagagaggtgctcatgtggtgatcggtgcccgaaacatgggagctgcagaaaacgccaaaacagagattctcagacaaaacgcaaacgcacgtgtcactcttcttcaattagatctctcttccatcaaatccatcaaagcctttgttcgtgaatttcatgccctccatcttcctctcaatctcctcataaacaatgcaggagtaatgttctgtccataccaactctctgaagatggaatcgaattgcagtttgctacaaatcacattggtcactttctgttgacaaacttgctcttggacacaatgaagaacacagctaaaaccagtggtgttgaaggaagaattttgaatgtatcatctgtagctcatatctatacttaccaagaaggaatccaattcgacagcatcaatgacatttgcagttactcggataagcgagcttacggacaatcgaaactagccaatatattgcatgctaatgagctctcccgtcagcttcaggaagaaggagtaaacataacagcaaattcagttcaccctggtcttattctcaccaatctcttccaacacactgctcttttaatgaggttcttgaagttcttcagcttctacttgtggaaaaatatacctcagggagcagcaacaacatgttatgttgctctgcatccaagtgtgaagggagtaacaggaaggtactttgctgattgcaacgaagtcactccaagcaaacttgctagagatgagactttggcacagaaactctgggatttcagtgttaagctcattaactcggtttctaaaaagaactacctcggtttcgatgacaccacttgaatctctacggtgttcttgttgaatgttacctaaagagtgaaaaaaaagtaagaacaagtagagattgtgatgtttctttccacattatcgtatggtaactcatgagatgcattgktgtatgcttaaatattttatcgagtgaatatgtaaccgcgtcaatcttttc

SEQ ID NO: 6625 - protein, 331 aa, Arabidopsis thaliana
  misc_feature (1)..(331): useful for making plants with modified plant phenotypes as described in USSN 12/139,269
  misc_feature (36)..(108): Pfam Name: Saccharop_dh; Pfam Description: Saccharopine dehydrogenase
  misc_feature (34)..(185): Pfam Name: adh_short; Pfam Description: short chain dehydrogenase
  misc_feature (36)..(208): Pfam Name: Epimerase; Pfam Description: NAD dependent epimerase/dehydratase family
  misc_feature (1)..(331): Utility: Useful for increasing chlorophyll and photosynthetic capacity
  misc_feature (1)..(331): Utility: Useful for making plants sterile and for genetic confinement
  misc_feature (1)..(331): Utility: Useful for making plants with altered leaf shape eg curled leaves
  misc_feature (1)..(331): Utility: Useful for making plants with increased biomass
  misc_feature (1)..(331): Utility: Useful for making smaller plants
MGLYSLITGRKGPSGFGSASTAEEVTQGIDATNLTAIITGGTGGIGMETARVLSKRGAHVVIGARNMGAAENAKTEILRQNANARVTLLQLDLSSIKSIKAFVREFHALHLPLNLLINNAGVMFCPYQLSEDGIELQFATNHIGHFLLTNLLLDTMKNTAKTSGVEGRILNVSSVAHIYTYQEGIQFDSINDICSYSDKRAYGQSKLANILHANELSRQLQEEGVNITANSVHPGLILTNLFQHTALLMRFLKFFSFYLWKNIPQGAATTCYVALHPSVKGVTGRYFADCNEVTPSKLARDETLAQKLWDFSVKLINSVSKKNYLGFDDTT

SEQ ID NO: 6626 - protein, 313 aa, Glycine max
  misc_feature (1)..(313): useful for making plants with modified plant phenotypes as described in USSN 12/139,269
  misc_feature (1)..(313): Ceres CLONE ID no. 463901
  misc_feature (1)..(313): Utility: Useful for increasing chlorophyll and photosynthetic capacity
  misc_feature (1)..(313): Utility: Useful for making plants sterile and for genetic confinement
  misc_feature (1)..(313): Utility: Useful for making plants with altered leaf shape eg curled leaves
  misc_feature (1)..(313): Utility: Useful for making plants with increased biomass
  misc_feature (1)..(313): Utility: Useful for making smaller plants
MAGPSGFGSASTAEQVTEGVDASNLTAIITGGASGIGLETARVLALRKVHVIIAVRNMVSAKEAKQQILEENESARVDIMKLDLCSVNSIRSFVDNFIALDLPLNILINNAGVMFCPFKLSEDGIEMQFATNHIGHFHLSNLLLDKMKQTAKATGIEGRIINLSSIAHNYTYRKGIRFNKINERKGYGNKRAYGQSKLANILHTNELSRRLQEEGVNITANSVHPGVIMTPLMRHSSYLMHFLKVFTFYIWKNVPQGAATTCYVALHPSVKGVTGKYFVDCNQCKPSSHAKNKQLAKKLWDFSNDLIKSISKA

SEQ ID NO: 6627 - protein, 313 aa, Glycine max
  misc_feature (1)..(313): useful for making plants with modified plant phenotypes as described in USSN 12/139,269
  misc_feature (1)..(313): Ceres CLONE ID no. 559449
  misc_feature (1)..(313): Utility: Useful for increasing chlorophyll and photosynthetic capacity
  misc_feature (1)..(313): Utility: Useful for making plants sterile and for genetic confinement
  misc_feature (1)..(313): Utility: Useful for making plants with altered leaf shape eg curled leaves
  misc_feature (1)..(313): Utility: Useful for making plants with increased biomass
  misc_feature (1)..(313): Utility: Useful for making smaller plants
MAGPSGFGSASTAEQVTDGIDASNLTAIITGGASGIGLETARVLALRKVHVIIAVRNMVSAKEAKQQILEENESARVDVMKLDLCSVNSITSFVDNFIALDLPLNILINNAGVMFCPFKLSEDGIEMQFATNHLGHFHLTNLLLDKMQQTAKATGIEGRIINLSSIAHNYTYRKGIRFNKINERKGYGNKKAYGQSKLANILHTNELSRRLQEEGVNITANSVHPGVIMTPLMRHSSYLMHFLKVFTFYIWKNVPQGAATTCYVALHPSVKGVTGKYFVDCNQCKPSSHAKNKQLAKKLWDFSNDLIKSISKA

SEQ ID NO: 6628 - protein, 349 aa, Glycine max
  misc_feature (1)..(349): useful for making plants with modified plant phenotypes as described in USSN 12/139,269
  misc_feature (1)..(349): Ceres CLONE ID no. 477913
  misc_feature (1)..(349): Utility: Useful for increasing chlorophyll and photosynthetic capacity
  misc_feature (1)..(349): Utility: Useful for making plants sterile and for genetic confinement
  misc_feature (1)..(349): Utility: Useful for making plants with altered leaf shape eg curled leaves
  misc_feature (1)..(349): Utility: Useful for making plants with increased biomass
  misc_feature (1)..(349): Utility: Useful for making smaller plants
MLLANVLGISVIRLSGGGASLSCVRVRKRECVCVQKMWPFSRKGASGFSSSSTAEQVTEGIDGTGLTAIVTGASSGIGTETTRVLSLRGVHVIMGVRNMLAAKDVKETLLKEIPSAKVDAMELDLSSLESVKKFASEFKSSGLPLNMLINNAGIMACPFKLSKDKIELQFATNHLGHFLLTNLLLDTMKKTSRETKKEGRIVNVSSEAHRFTYSEGIRFDKINDESSYSNWRAYGQSKLANILHANELTRRLKEDGVDISANSLHPGVIATNLSRHISPVNGLTKAIARLVLKNVQQGAATTCYVALHPQVKGTSGKYFSASNVAKTTSQGTDADLAKNLWDFSMDLTK

SEQ ID NO: 6629 - protein, 315 aa, Zea mays
  misc_feature (1)..(315): useful for making plants with modified plant phenotypes as described in USSN 12/139,269
  misc_feature (1)..(315): Ceres CLONE ID no. 277275
  misc_feature (1)..(315): Utility: Useful for increasing chlorophyll and photosynthetic capacity
  misc_feature (1)..(315): Utility: Useful for making plants sterile and for genetic confinement
  misc_feature (1)..(315): Utility: Useful for making plants with altered leaf shape eg curled leaves
  misc_feature (1)..(315): Utility: Useful for making plants with increased biomass
  misc_feature (1)..(315): Utility: Useful for making smaller plants
MTSWLLGRRGPSGFSWSSTADQVTQGISAAGLTAIVTGASSGIGAETARTLALRGAHVIMAVRSLPAAQAVKDAVLAQAPGAKLDVMELDLSSMASVRAFASQFIDRGLPLNILINNAGVMAIPFALSKDGIEMQFATNHVGHFLLTHLLLDTMKRTSHESNLEGRIVNVSSEGHRLAYREGIRFDKINDESVYSSIGAYGQSKLANILHANELARRFEEDNVNITANSLHPGSIITNLLRYHSILDVLHRTLGKLVLKNAEQGAATTCYLALHPHVKGVSGKYFCDCNLYEPSANAKDMELAKRLWDFGVELIT

SEQ ID NO: 6630 - protein, 315 aa, Zea mays; identical to SEQ ID NO: 6629
  misc_feature (1)..(315): useful for making plants with modified plant phenotypes as described in USSN 12/139,269
  misc_feature (1)..(315): Ceres CLONE ID no. 1283429
  misc_feature (1)..(315): Utility: Useful for increasing chlorophyll and photosynthetic capacity
  misc_feature (1)..(315): Utility: Useful for making plants sterile and for genetic confinement
  misc_feature (1)..(315): Utility: Useful for making plants with altered leaf shape eg curled leaves
  misc_feature (1)..(315): Utility: Useful for making plants with increased biomass
  misc_feature (1)..(315): Utility: Useful for making smaller plants

SEQ ID NO: 6631 - protein, 367 aa, Zea mays
  misc_feature (1)..(367): useful for making plants with modified plant phenotypes as described in USSN 12/139,269
  misc_feature (1)..(367): Ceres CLONE ID no. 239740
  misc_feature (1)..(367): Utility: Useful for increasing chlorophyll and photosynthetic capacity
  misc_feature (1)..(367): Utility: Useful for making plants sterile and for genetic confinement
  misc_feature (1)..(367): Utility: Useful for making plants with altered leaf shape eg curled leaves
  misc_feature (1)..(367): Utility: Useful for making plants with increased biomass
  misc_feature (1)..(367): Utility: Useful for making smaller plants
MFEQAVADFCWHAREVVSSGMGLWGWPWGRRGPSGFGSASTAEEVTAGVDASNITAIVTGATNGIGKETARVLALRGAKVIIPARTLESGLKLKESLADEVPSSKVHVMEMDLSCLSSVRDFARSFNSSHKHLNLLINNAGIMACPYQLSKDGIELQFATNHVGHFLLTSLLLDKMKSTAAETGVQGRIINVSSVAHKRSDGTCFELNKLNDKARYQPFIAYAHSKLANVLHTNELSRRFQEEGCNLTANSLHPGVIVTNIIRYVAGNSALISALSPVANLVLKSVPRGAATTCYLALHPNVKGVSGKYFADCNEATPTAVARDSELAKRLWSFSEELVKIYADMSQTTQASEEEETTVTKDVFQDK

SEQ ID NO: 6632 - DNA, 817 bp, Arabidopsis thaliana
  misc_feature (1)..(817): useful for making plants with modified plant phenotypes as described in USSN 12/139,269
  misc_feature (1)..(817): Ceres CLONE ID no. 117369
  misc_feature (1)..(817): Also known as  Ceres CDNA ID no. 23360906
gggacagtggacggatttgctcgctagttttctcttcgaattttccacaaacaaattttctcagccaaagttcgatcggatctgggttttatatttttttgaagaacccgtgtccgtcttcgatcagttcgcgttcaatagccaaatcttatctcttcagctggaatctgacgaacattattatcatcggtagtgttctatagaaagaccgaaagttttcttcaatttcaaagtcagtggcgatgtcgtgggctggtcctgaagaaatttatctttcaacatcactcgctagttatctcgatagaaaactacttgtgcttcttagagatggtagaaagctaatgggaacactccgttcctttgatcaattcgccaatgcggttctagaaggtgcgtgtgagagggtaattgttggtgaacaatactgtgacattcctttaggcctctatgtaatccgtggagagaatgttgttttgattggtgagctggacacggagagagaagagcttcctccacatatgattcgcgtctcagaggcagagattaaaagggcacaaaaggtggagagggaagcgagtgagctgagaggaacaatgaggaagagaatggagtttcttgactttgattaaaccagattgtatccccattcattattggcttgatgctctgctttggctcgcaagttttatgatgagcctttttggtgtgttgacttaggggatcgacgcaattcttgtgtttcattttggatgaatatgacaataaatctgtgtacttttgtctttggatctatttacctttttaagaaaaaaatgtt

SEQ ID NO: 6633 - protein, 128 aa, Arabidopsis thaliana
  misc_feature (1)..(128): useful for making plants with modified plant phenotypes as described in USSN 12/139,269
  misc_feature (13)..(81): Pfam Name: LSM; Pfam Description: LSM domain
  misc_feature (1)..(128): Utility: Useful for increasing chlorophyll and photosynthetic capacity
  misc_feature (1)..(128): Utility: Useful for increasing seed/fruit yield or modifying fruit content
  misc_feature (1)..(128): Utility: Useful for making ornamental plants with modified flowers
  misc_feature (1)..(128): Utility: Useful for making ornamental plants with modified leaves
  misc_feature (1)..(128): Utility: Useful for making plants sterile and for genetic confinement
  misc_feature (1)..(128): Utility: Useful for making plants with altered leaf shape eg curled leaves
  misc_feature (1)..(128): Utility: Useful for making plants with increased biomass
  misc_feature (1)..(128): Utility: Useful for making plants with increased biomass and foliage
MSWAGPEEIYLSTSLASYLDRKLLVLLRDGRKLMGTLRSFDQFANAVLEGACERVIVGEQYCDIPLGLYVIRGENVVLIGELDTEREELPPHMIRVSEAEIKRAQKVEREASELRGTMRKRMEFLDFD

SEQ ID NO: 6634 - protein, 95 aa, Brassica napus
  misc_feature (1)..(95): useful for making plants with modified plant phenotypes as described in USSN 12/139,269
  misc_feature (1)..(95): Ceres CLONE ID no. 968213
  misc_feature (1)..(95): Utility: Useful for increasing chlorophyll and photosynthetic capacity
  misc_feature (1)..(95): Utility: Useful for increasing seed/fruit yield or modifying fruit content
  misc_feature (1)..(95): Utility: Useful for making ornamental plants with modified flowers
  misc_feature (1)..(95): Utility: Useful for making ornamental plants with modified leaves
  misc_feature (1)..(95): Utility: Useful for making plants sterile and for genetic confinement
  misc_feature (1)..(95): Utility: Useful for making plants with altered leaf shape eg curled leaves
  misc_feature (1)..(95): Utility: Useful for making plants with increased biomass
  misc_feature (1)..(95): Utility: Useful for making plants with increased biomass and foliage
  misc_feature (39)..(39): Xaa is any aa, unknown or other
MGTLRSFDQFANAVLEGACERVIVGEQYCDIPLGLYVIXGENVVLIGEMDTEREELPPHMIRVSETEIKRAQKVEREAGELRGTMRKRMEFLDFD

SEQ ID NO: 6635 - protein, 128 aa, Brassica napus
  misc_feature (1)..(128): useful for making plants with modified plant phenotypes as described in USSN 12/139,269
  misc_feature (1)..(128): Ceres CLONE ID no. 952177
  misc_feature (1)..(128): Utility: Useful for increasing chlorophyll and photosynthetic capacity
  misc_feature (1)..(128): Utility: Useful for increasing seed/fruit yield or modifying fruit content
  misc_feature (1)..(128): Utility: Useful for making ornamental plants with modified flowers
  misc_feature (1)..(128): Utility: Useful for making ornamental plants with modified leaves
  misc_feature (1)..(128): Utility: Useful for making plants sterile and for genetic confinement
  misc_feature (1)..(128): Utility: Useful for making plants with altered leaf shape eg curled leaves
  misc_feature (1)..(128): Utility: Useful for making plants with increased biomass
  misc_feature (1)..(128): Utility: Useful for making plants with increased biomass and foliage
  misc_feature (84)..(84): Xaa is any aa, unknown or other
MSWAGPEDMYLSTSLASYLDRKILVLLRDGRKLMGTLRSFDQFANAVLEGACERVIVGEQYCDIPLGLYVIRGENVVLIGDLDXEREELPPHMIRVSETEIKRAQKVEREASELRGTMRKRMEFLDFD

SEQ ID NO: 6636 - protein, 95 aa, Glycine max
  misc_feature (1)..(95): useful for making plants with modified plant phenotypes as described in USSN 12/139,269
  misc_feature (1)..(95): Ceres CLONE ID no. 716576
  misc_feature (1)..(95): Utility: Useful for increasing chlorophyll and photosynthetic capacity
  misc_feature (1)..(95): Utility: Useful for increasing seed/fruit yield or modifying fruit content
  misc_feature (1)..(95): Utility: Useful for making ornamental plants with modified flowers
  misc_feature (1)..(95): Utility: Useful for making ornamental plants with modified leaves
  misc_feature (1)..(95): Utility: Useful for making plants sterile and for genetic confinement
  misc_feature (1)..(95): Utility: Useful for making plants with altered leaf shape eg curled leaves
  misc_feature (1)..(95): Utility: Useful for making plants with increased biomass
  misc_feature (1)..(95): Utility: Useful for making plants with increased biomass and foliage
  misc_feature (24)..(24): Xaa is any aa, unknown or other
MGTLRSFDQFANAVLEGACERVIXGDLYCDIPLGLYVIRGENVVLIGELDLEREELPEHMTRVSTAEIKRAQKAEREASDLKGTMRKRMEFLDFD

SEQ ID NO: 6637 - protein, 136 aa, Glycine max
  misc_feature (1)..(136): useful for making plants with modified plant phenotypes as described in USSN 12/139,269
  misc_feature (1)..(136): Public GI no. 50924582
  misc_feature (1)..(136): Utility: Useful for increasing chlorophyll and photosynthetic capacity
  misc_feature (1)..(136): Utility: Useful for increasing seed/fruit yield or modifying fruit content
  misc_feature (1)..(136): Utility: Useful for making ornamental plants with modified flowers
  misc_feature (1)..(136): Utility: Useful for making ornamental plants with modified leaves
  misc_feature (1)..(136): Utility: Useful for making plants sterile and for genetic confinement
  misc_feature (1)..(136): Utility: Useful for making plants with altered leaf shape eg curled leaves
  misc_feature (1)..(136): Utility: Useful for making plants with increased biomass
  misc_feature (1)..(136): Utility: Useful for making plants with increased biomass and foliage
MSSWAGPDEIFLSTSLAGFLDKKLIVLLRDGRKLLGTLCSFDQFANVVLQGACERVIVGELYCDVPLGLYVIRGENVVLIGELVWFWIEQDREKDELPAHMTCVSEAEIRKAEKAEREARDLKGSMRKRMEFLDFD

SEQ ID NO: 6638 - protein, 128 aa, Zea mays
  misc_feature (1)..(128): useful for making plants with modified plant phenotypes as described in USSN 12/139,269
  misc_feature (1)..(128): Ceres CLONE ID no. 218224
  misc_feature (1)..(128): Utility: Useful for increasing chlorophyll and photosynthetic capacity
  misc_feature (1)..(128): Utility: Useful for increasing seed/fruit yield or modifying fruit content
  misc_feature (1)..(128): Utility: Useful for making ornamental plants with modified flowers
  misc_feature (1)..(128): Utility: Useful for making ornamental plants with modified leaves
  misc_feature (1)..(128): Utility: Useful for making plants sterile and for genetic confinement
  misc_feature (1)..(128): Utility: Useful for making plants with altered leaf shape eg curled leaves
  misc_feature (1)..(128): Utility: Useful for making plants with increased biomass
  misc_feature (1)..(128): Utility: Useful for making plants with increased biomass and foliage
MSWSAPDDILLSTSLAGFLDKKLIVLLRDGRKLLGTLCSFDQFANVVLQGACERVIVGEQYCDVPLGLYVIRGENVVLIGELDREKDELPAHMTCVSEAEIRKAEKAEREARDLKGTMRKRMEFLDFD

SEQ ID NO: 6639 - protein, 128 aa, Zea mays; identical to SEQ ID NO: 6638
  misc_feature (1)..(128): useful for making plants with modified plant phenotypes as described in USSN 12/139,269
  misc_feature (1)..(128): Ceres CLONE ID no. 1283561
  misc_feature (1)..(128): Utility: Useful for increasing chlorophyll and photosynthetic capacity
  misc_feature (1)..(128): Utility: Useful for increasing seed/fruit yield or modifying fruit content
  misc_feature (1)..(128): Utility: Useful for making ornamental plants with modified flowers
  misc_feature (1)..(128): Utility: Useful for making ornamental plants with modified leaves
  misc_feature (1)..(128): Utility: Useful for making plants sterile and for genetic confinement
  misc_feature (1)..(128): Utility: Useful for making plants with altered leaf shape eg curled leaves
  misc_feature (1)..(128): Utility: Useful for making plants with increased biomass
  misc_feature (1)..(128): Utility: Useful for making plants with increased biomass and foliage

SEQ ID NO: 6640 - protein, 128 aa, Triticum aestivum
  misc_feature (1)..(128): useful for making plants with modified plant phenotypes as described in USSN 12/139,269
  misc_feature (1)..(128): Ceres CLONE ID no. 639565
  misc_feature (1)..(128): Utility: Useful for increasing chlorophyll and photosynthetic capacity
  misc_feature (1)..(128): Utility: Useful for increasing seed/fruit yield or modifying fruit content
  misc_feature (1)..(128): Utility: Useful for making ornamental plants with modified flowers
  misc_feature (1)..(128): Utility: Useful for making ornamental plants with modified leaves
  misc_feature (1)..(128): Utility: Useful for making plants sterile and for genetic confinement
  misc_feature (1)..(128): Utility: Useful for making plants with altered leaf shape eg curled leaves
  misc_feature (1)..(128): Utility: Useful for making plants with increased biomass
  misc_feature (1)..(128): Utility: Useful for making plants with increased biomass and foliage
MSWAGPDEILLSTSLAGFLDKKLIVLLRDGRKLLGTLCSFDQFANVVLQGACERVIVGELYCDVPFGLYVIRGENVVLIGELDREKDELPSHMTCVSEAEIRTAEKAEKEARDLKGTMRKRMEFLDFD

SEQ ID NO: 6641 - protein, 128 aa, Zea mays
  misc_feature (1)..(128): useful for making plants with modified plant phenotypes as described in USSN 12/139,269
  misc_feature (1)..(128): Ceres CLONE ID no. 1273479
  misc_feature (1)..(128): Utility: Useful for increasing chlorophyll and photosynthetic capacity
  misc_feature (1)..(128): Utility: Useful for increasing seed/fruit yield or modifying fruit content
  misc_feature (1)..(128): Utility: Useful for making ornamental plants with modified flowers
  misc_feature (1)..(128): Utility: Useful for making ornamental plants with modified leaves
  misc_feature (1)..(128): Utility: Useful for making plants sterile and for genetic confinement
  misc_feature (1)..(128): Utility: Useful for making plants with altered leaf shape eg curled leaves
  misc_feature (1)..(128): Utility: Useful for making plants with increased biomass
  misc_feature (1)..(128): Utility: Useful for making plants with increased biomass and foliage
MSWSAPDDILLSTSLAGFLDKKLIVLLRDGRKLLGTLCSFDQFANVVLQGACERVIVGGQYCDVPLGLYVIRGENVVLIGELDHEKDELPAHMTCVLEAEIRKAEKAEREARDLKGTMRKRMEFLDFD

SEQ ID NO: 6642 - protein, 105 aa, Zea mays
  misc_feature (1)..(105): useful for making plants with modified plant phenotypes as described in USSN 12/139,269
  misc_feature (1)..(105): Ceres CLONE ID no. 1389544
  misc_feature (1)..(105): Utility: Useful for increasing chlorophyll and photosynthetic capacity
  misc_feature (1)..(105): Utility: Useful for increasing seed/fruit yield or modifying fruit content
  misc_feature (1)..(105): Utility: Useful for making ornamental plants with modified flowers
  misc_feature (1)..(105): Utility: Useful for making ornamental plants with modified leaves
  misc_feature (1)..(105): Utility: Useful for making plants sterile and for genetic confinement
  misc_feature (1)..(105): Utility: Useful for making plants with altered leaf shape eg curled leaves
  misc_feature (1)..(105): Utility: Useful for making plants with increased biomass
  misc_feature (1)..(105): Utility: Useful for making plants with increased biomass and foliage
  misc_feature (88)..(88): Xaa is any aa, unknown or other
  misc_feature (104)..(104): Xaa is any aa, unknown or other
MSWSAPDDILLSTSLAGFLDTNVVLQGACERVIVGEQYCDVPLGLYVIRGENVVLIGELDREKDELPAHMTCVSEAEIRKAEKAEREXRDLKGTMRKRMEFLDXD

SEQ ID NO: 6643 - DNA, 777 bp, Arabidopsis thaliana
  misc_feature (1)..(777): useful for making plants with modified plant phenotypes as described in USSN 12/139,269
  misc_feature (1)..(777): Ceres CLONE ID no. 118337
  misc_feature (1)..(777): Also known as  Ceres CDNA ID no. 23385924
ctctctcttaggttttttttcccttctcccaatctcatcttctccgaaaacctttcttctctcaaatttctgtgaaaacatgtctgacgacgagcaccactttgaggccagcgaatccggagcttccaagacctatcctcaatcagccggtaacatccgtaaaggtggtcacatcgtcatcaaaaaccgtccctgcaaggttgttgaggtttcgacttccaaaactggcaagcacggtcacgccaaatgtcactttgttgctattgatatcttcactgctaagaagcttgaagatattgttccatcttcccacaattgtgatgttccacatgtgaaccgtgttgattaccagttgattgatatcactgaggatggcttcgtgagccttctcactgacagtggtggcaccaaggatgatctcaagcttcccaccgatgatggtctcaccgcccagttgttgtgttttgttaatgcacatgaggcttggattcgatgagggaaaggatattgtggtgtctgtcatgtcttccatgggagaggagcagatctgtgccgtcaaggaagttggtggtggcaagtaaacaagtatcattcgatatattattaccagtttgacaacggacgtcaatgttataagaaccaaaagatgtttttctttttcctaatttagaccctttgtgtgtgtttcttgttgcaagacaaccatatctattggttttggattgttggaaaagtttgtgttgaaacattcaaagtttcttatgagatgttattctc

SEQ ID NO: 6644 - protein, 138 aa, Arabidopsis thaliana
  misc_feature (1)..(138): useful for making plants with modified plant phenotypes as described in USSN 12/139,269
  misc_feature (26)..(62): Pfam Name: KOW; Pfam Description: KOW motif
  misc_feature (84)..(137): Pfam Name: eIF-5a; Pfam Description: Eukaryotic initiation factor 5A hypusine, DNA-binding OB fold
  misc_feature (1)..(138): Utility: Useful for increasing chlorophyll and photosynthetic capacity
  misc_feature (1)..(138): Utility: Useful for making plants with increased biomass and foliage
  misc_feature (1)..(138): Utility: Useful for making shorter plants and plants with modified flowers
  misc_feature (1)..(138): Utility: Useful for making smaller plants
MSDDEHHFEASESGASKTYPQSAGNIRKGGHIVIKNRPCKVVEVSTSKTGKHGHAKCHFVAIDIFTAKKLEDIVPSSHNCDVPHVNRVDYQLIDITEDGFVSLLTDSGGTKDDLKLPTDDGLTAQLLCFVNAHEAWIR

SEQ ID NO: 6645 - protein, 154 aa, Zea mays
  misc_feature (1)..(154): useful for making plants with modified plant phenotypes as described in USSN 12/139,269
  misc_feature (1)..(154): Ceres CLONE ID no. 1389175
  misc_feature (1)..(154): Utility: Useful for increasing chlorophyll and photosynthetic capacity
  misc_feature (1)..(154): Utility: Useful for making plants with increased biomass and foliage
  misc_feature (1)..(154): Utility: Useful for making shorter plants and plants with modified flowers
  misc_feature (1)..(154): Utility: Useful for making smaller plants
  misc_feature (116)..(116): Xaa is any aa, unknown or other
  misc_feature (117)..(117): Xaa is any aa, unknown or other
  misc_feature (118)..(118): Xaa is any aa, unknown or other
  misc_feature (137)..(137): Xaa is any aa, unknown or other
MSDEEHHFESSDAGASKTYPQQAGNIRKGGHIVIKGRPCKVVEVSTSKTGKHGHAKCHFVAIDIFTAKKLEDIVPSSHNCDVPHVNRIDYQLIDISEDGFVSLLTDSGGTKDDLKXXXDDSLSALMKSGFEEGKDVXVSVMSSMGEEQICAVKG

SEQ ID NO: 6646 - protein, 123 aa, Brassica napus
  misc_feature (1)..(123): useful for making plants with modified plant phenotypes as described in USSN 12/139,269
  misc_feature (1)..(123): Ceres CLONE ID no. 1069165
  misc_feature (1)..(123): Utility: Useful for increasing chlorophyll and photosynthetic capacity
  misc_feature (1)..(123): Utility: Useful for making plants with increased biomass and foliage
  misc_feature (1)..(123): Utility: Useful for making shorter plants and plants with modified flowers
  misc_feature (1)..(123): Utility: Useful for making smaller plants
  misc_feature (111)..(111): Xaa is any aa, unknown or other
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGXTKDDLKLPTDDV

SEQ ID NO: 6647 - protein, 125 aa, Triticum aestivum
  misc_feature (1)..(125): useful for making plants with modified plant phenotypes as described in USSN 12/139,269
  misc_feature (1)..(125): Ceres CLONE ID no. 1326914
  misc_feature (1)..(125): Utility: Useful for increasing chlorophyll and photosynthetic capacity
  misc_feature (1)..(125): Utility: Useful for making plants with increased biomass and foliage
  misc_feature (1)..(125): Utility: Useful for making shorter plants and plants with modified flowers
  misc_feature (1)..(125): Utility: Useful for making smaller plants
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLKLPTDDVLL

SEQ ID NO: 6648 - protein, 161 aa, Triticum aestivum
  misc_feature (1)..(161): useful for making plants with modified plant phenotypes as described in USSN 12/139,269
  misc_feature (1)..(161): Ceres CLONE ID no. 567871
  misc_feature (1)..(161): Utility: Useful for increasing chlorophyll and photosynthetic capacity
  misc_feature (1)..(161): Utility: Useful for making plants with increased biomass and foliage
  misc_feature (1)..(161): Utility: Useful for making shorter plants and plants with modified flowers
  misc_feature (1)..(161): Utility: Useful for making smaller plants
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLKLPTDDVLLGQIKTGFADGKDLILSVMSAMGEEQICAVKEIGGGK

SEQ ID NO: 6649 - protein, 146 aa, Triticum aestivum
  misc_feature (1)..(146): useful for making plants with modified plant phenotypes as described in USSN 12/139,269
  misc_feature (1)..(146): Ceres CLONE ID no. 743658
  misc_feature (1)..(146): Utility: Useful for increasing chlorophyll and photosynthetic capacity
  misc_feature (1)..(146): Utility: Useful for making plants with increased biomass and foliage
  misc_feature (1)..(146): Utility: Useful for making shorter plants and plants with modified flowers
  misc_feature (1)..(146): Utility: Useful for making smaller plants
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLKLPTDDVLLGQIKTGFADGKDLILSGCPPG

SEQ ID NO: 6650 - protein, 155 aa, Glycine max
  misc_feature (1)..(155): useful for making plants with modified plant phenotypes as described in USSN 12/139,269
  misc_feature (1)..(155): Ceres CLONE ID no. 1488709
  misc_feature (1)..(155): Utility: Useful for increasing chlorophyll and photosynthetic capacity
  misc_feature (1)..(155): Utility: Useful for making plants with increased biomass and foliage
  misc_feature (1)..(155): Utility: Useful for making shorter plants and plants with modified flowers
  misc_feature (1)..(155): Utility: Useful for making smaller plants
  misc_feature (122)..(122): Xaa is any aa, unknown or other
  misc_feature (123)..(123): Xaa is any aa, unknown or other
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLKLPTDXXLLGQIKTGFADGKDLILSVMSAMGEEQICAVK

SEQ ID NO: 6651 - protein, 138 aa, Glycine max
  misc_feature (1)..(138): useful for making plants with modified plant phenotypes as described in USSN 12/139,269
  misc_feature (1)..(138): Ceres CLONE ID no. 1075190
  misc_feature (1)..(138): Utility: Useful for increasing chlorophyll and photosynthetic capacity
  misc_feature (1)..(138): Utility: Useful for making plants with increased biomass and foliage
  misc_feature (1)..(138): Utility: Useful for making shorter plants and plants with modified flowers
  misc_feature (1)..(138): Utility: Useful for making smaller plants
  misc_feature (116)..(116): Xaa is any aa, unknown or other
  misc_feature (134)..(134): Xaa is any aa, unknown or other
MSETDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDXEASTDDVLLGQIKTGFAXGKDL

SEQ ID NO: 6652 - protein, 127 aa, Brassica napus
  misc_feature (1)..(127): useful for making plants with modified plant phenotypes as described in USSN 12/139,269
  misc_feature (1)..(127): Ceres CLONE ID no. 939972
  misc_feature (1)..(127): Utility: Useful for increasing chlorophyll and photosynthetic capacity
  misc_feature (1)..(127): Utility: Useful for making plants with increased biomass and foliage
  misc_feature (1)..(127): Utility: Useful for making shorter plants and plants with modified flowers
  misc_feature (1)..(127): Utility: Useful for making smaller plants
MSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQ

SEQ ID NO: 6653 - protein, 135 aa, Zea mays
  misc_feature (1)..(135): useful for making plants with modified plant phenotypes as described in USSN 12/139,269
  misc_feature (1)..(135): Ceres CLONE ID no. 388126
  misc_feature (1)..(135): Utility: Useful for increasing chlorophyll and photosynthetic capacity
  misc_feature (1)..(135): Utility: Useful for making plants with increased biomass and foliage
  misc_feature (1)..(135): Utility: Useful for making shorter plants and plants with modified flowers
  misc_feature (1)..(135): Utility: Useful for making smaller plants
MSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAAACSCHLPF

SEQ ID NO: 6654 - protein, 160 aa, Zea mays
  misc_feature (1)..(160): useful for making plants with modified plant phenotypes as described in USSN 12/139,269
  misc_feature (1)..(160): Ceres CLONE ID no. 1289769
  misc_feature (1)..(160): Utility: Useful for increasing chlorophyll and photosynthetic capacity
  misc_feature (1)..(160): Utility: Useful for making plants with increased biomass and foliage
  misc_feature (1)..(160): Utility: Useful for making shorter plants and plants with modified flowers
  misc_feature (1)..(160): Utility: Useful for making smaller plants
MSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPK

SEQ ID NO: 6655 - protein, 134 aa, Zea mays
  misc_feature (1)..(134): useful for making plants with modified plant phenotypes as described in USSN 12/139,269
  misc_feature (1)..(134): Ceres CLONE ID no. 687467
  misc_feature (1)..(134): Utility: Useful for increasing chlorophyll and photosynthetic capacity
  misc_feature (1)..(134): Utility: Useful for making plants with increased biomass and foliage
  misc_feature (1)..(134): Utility: Useful for making shorter plants and plants with modified flowers
  misc_feature (1)..(134): Utility: Useful for making smaller plants
  misc_feature (125)..(125): Xaa is any aa, unknown or other
MSDSEEHHFESKADAGASKTYPQQAGTVRKNGFIVIKNRPCKVVEVSTSKTGKHGHAKSPFGAINIFNGKKLEDIGPSSPNCDIPHVNRTEYQLIDISEDGFVSLLTSDGNTKDDLRLPTDETLXAQIKEGFES

SEQ ID NO: 6656 - DNA, 1123 bp, Arabidopsis thaliana
  misc_feature (1)..(1123): useful for making plants with modified plant phenotypes as described in USSN 12/139,269
  misc_feature (1)..(1123): Ceres CLONE ID no. 150912
  misc_feature (1)..(1123): Also known as  Ceres CDNA ID no. 23388597
atcaaaggagagagatcgacaatggcaccttcgtcatcaagcggtttaaccttcaagctacatcctttggtaatcgtcaacatatcggatcactacactagggtcaaaactcagctcaatcctcctgcttcaatctgcgcaagcggccatggctcaaacaacggcgaagcaatgttccagcaaaaccctagggtttacggatgtgtgatcggtgtccagagaggtcgtactgttgagatattcaacagtttcgagcttttatatgatccttctactcaaaccctcgatagatctttcctcgagaagaagcaagagctctataagaaggtgttccctgatttctatattctgggatggtactctacgggaagtgatgctgaggaatctgatatgcatatccataaagctttgatggatatcaatgaatctcctgtttatgtgcttttaaaccctgctatcaatcacacacagaaggatcttccagtgactatttatgaaagtgaattgcatgtcattgatggaatcccgcagctaattttcgctcatacaagctacacaatcgagacagttgaagctgaacggatatcagttgatcatgttgcacatcttaaaccatctgacggaggctcagcagcaacccagttggctgctcatcttactggtatacatagtgccatcaagatgcttaatagcagaatcagagtgctttaccaaaatcttgctgcaatgcagaaaggtgataaatcttgtgacaactcagttctgagacaagtatctagcctgctaagaagattgcctgccatggaatcagagagatttcaagataatttcttgatggagtacaacgacaaattactaataacttacctagcgatgattacaaattgttccagcaacatgaacgagatggtcgacaaattcaacaccgcatatgacagaaacactcgaagaggtggaagaactgcattcatgtaaaagatcctttccagcgattctagttctaaagatcttctcttggttcctgaaaccatttttaacattgcctctgtgagaatctataactcagacggcaagactttatcctcttcattgtttctatatctataagaacatctgcttatct

SEQ ID NO: 6657 - protein, 317 aa, Arabidopsis thaliana
  misc_feature (1)..(317): useful for making plants with modified plant phenotypes as described in USSN 12/139,269
  misc_feature (6)..(136): Pfam Name: Mov34; Pfam Description: Mov34/MPN/PAD-1 family
  misc_feature (6)..(136): Pfam Name: Mov34; Pfam Description: Mov34/MPN/PAD-1 family
  misc_feature (1)..(317): Utility: Useful for increasing chlorophyll and photosynthetic capacity
  misc_feature (1)..(317): Utility: Useful for making ornamental plants with modified leaves
  misc_feature (1)..(317): Utility: Useful for making plants sterile and for genetic confinement
  misc_feature (1)..(317): Utility: Useful for making smaller plants
  misc_feature (1)..(317): Utility: Useful for making stronger plants
MAPSSSSGLTFKLHPLVIVNISDHYTRVKTQLNPPASICASGHGSNNGEAMFQQNPRVYGCVIGVQRGRTVEIFNSFELLYDPSTQTLDRSFLEKKQELYKKVFPDFYILGWYSTGSDAEESDMHIHKALMDINESPVYVLLNPAINHTQKDLPVTIYESELHVIDGIPQLIFAHTSYTIETVEAERISVDHVAHLKPSDGGSAATQLAAHLTGIHSAIKMLNSRIRVLYQNLAAMQKGDKSCDNSVLRQVSSLLRRLPAMESERFQDNFLMEYNDKLLITYLAMITNCSSNMNEMVDKFNTAYDRNTRRGGRTAFM

SEQ ID NO: 6658 - protein, 318 aa, Arabidopsis thaliana
  misc_feature (1)..(318): useful for making plants with modified plant phenotypes as described in USSN 12/139,269
  misc_feature (1)..(318): Public GI no. 17940314
  misc_feature (1)..(318): Utility: Useful for increasing chlorophyll and photosynthetic capacity
  misc_feature (1)..(318): Utility: Useful for making ornamental plants with modified leaves
  misc_feature (1)..(318): Utility: Useful for making plants sterile and for genetic confinement
  misc_feature (1)..(318): Utility: Useful for making smaller plants
  misc_feature (1)..(318): Utility: Useful for making stronger plants
MAPSSSSGLTFKLHPLVMLNISDHFTRVKTQLNPPAASCATGNGSNNADAMLLQNPRVYGCVIGLQRGRTVEIFNSFELIFDPALDTLDRSFLEKKQELYKKVFPDFYVLGWYSTGSDATESDMHIHKALMDINESPVYVLLNPAINHAQKDLPVTIYESEFHVIDGIPQSIFVHTSYTIETVEAERISVDHVAHLKPSDGGSAATQVAAHLTGIHSAIKMLNSRIRVLYQHIVAMQKGCDKPCENSVLRQVSSLLRSLPAAESEKFNENFLMEYNDKLLMSYLAMITNCTSNMNEVVDKFNTAYDKHSRRGGRTAFM

SEQ ID NO: 6659 - protein, 300 aa, Arabidopsis thaliana
  misc_feature (1)..(300): useful for making plants with modified plant phenotypes as described in USSN 12/139,269
  misc_feature (1)..(300): Ceres CLONE ID no. 36616
  misc_feature (1)..(300): Utility: Useful for increasing chlorophyll and photosynthetic capacity
  misc_feature (1)..(300): Utility: Useful for making ornamental plants with modified leaves
  misc_feature (1)..(300): Utility: Useful for making plants sterile and for genetic confinement
  misc_feature (1)..(300): Utility: Useful for making smaller plants
  misc_feature (1)..(300): Utility: Useful for making stronger plants
MLNISDHFTRVKTQLNPPAASCATGNGSNNADAMLLQNPRVYGCVIGLQRGRTVEIFNSFELIFDPALDTLDRSFLEKKQELYKKVFPDFYVLGWYSTGSDATESDMHIHKALMDINESPVYVLLNPAINHAQKDLPVTIYESEFHVIDGIPQSIFVHTSYTIETVEAERISVDHVAHLKPSDGGSAATQLAAHLTGIHSAIKMLNSRIRVLYQHIVAMQKGDKPCENSVLRQVSSLLRSLPAAESEKFNENFLMEYNDKLLMSYLAMITNCTSNMNEVVDKFNTAYDKHSRRGGRTAFM

SEQ ID NO: 6660 - protein, 329 aa, Arabidopsis thaliana
  misc_feature (1)..(329): useful for making plants with modified plant phenotypes as described in USSN 12/139,269
  misc_feature (1)..(329): Public GI no. 50947311
  misc_feature (1)..(329): Utility: Useful for increasing chlorophyll and photosynthetic capacity
  misc_feature (1)..(329): Utility: Useful for making ornamental plants with modified leaves
  misc_feature (1)..(329): Utility: Useful for making plants sterile and for genetic confinement
  misc_feature (1)..(329): Utility: Useful for making smaller plants
  misc_feature (1)..(329): Utility: Useful for making stronger plants
MSAPSDPAVATHPQAGAAAAASSSSGLTFKLHPLVIVNVSDHHTRVKAQAACSGDGASSAAAGGQPPRVFGCVIGVQRGRTVEIFNSFELVLDPVSGTLDRAFLEKKQELYKKVFPDFYVLGWYSTGSDVRDTDMQIHKALMDINESPVYLLLNPAINLSQKDLPVTIYESELHVIDGSPQLIFVRANYTIETVEAERISVDHVAHLKPSDGGSAATQLAAHLTGIHSAIKMLNSRVRVIHQYLVSMQKGDMPLDNSLLRQVSSLVRRLPAMESEKFQDDFLMEYNDTLLMTYLAMFTNCSSTMNELVEKFNATYERSTARRGGRGAFM

SEQ ID NO: 6661 - protein, 332 aa, Zea mays
  misc_feature (1)..(332): useful for making plants with modified plant phenotypes as described in USSN 12/139,269
  misc_feature (1)..(332): Ceres CLONE ID no. 328761
  misc_feature (1)..(332): Utility: Useful for increasing chlorophyll and photosynthetic capacity
  misc_feature (1)..(332): Utility: Useful for making ornamental plants with modified leaves
  misc_feature (1)..(332): Utility: Useful for making plants sterile and for genetic confinement
  misc_feature (1)..(332): Utility: Useful for making smaller plants
  misc_feature (1)..(332): Utility: Useful for making stronger plants
MSAPSDAAVAAAAPASTTTAAASSGGLTFKLHPLVIVNVSDHHTRVKAQAACSGDSSSPSSSAPGAGQPPRVFGCVIGVQRGRTVEIFNSFELVLDPVSGTLDRAFLDKKQELYKKVFPDFYVLGWYSTGSDVHDTDMLIHKSLMDINESPVYLLLNPTINLSQKDLPVTIYESELHVIDGIPQLIFVRSNYTIETVEAERISVDHVAHLKPSDGGSAATQLAAHLTGIHSAIKMLNSRVRVIHQYLVAMQKGDIPLDNSLLRQVSSLVRRLPAMESQKFQDDFLMEYNDTLLMTYLAMVTKCSSTMNELVEKINTSYERTTSRRGGRGAFM

SEQ ID NO: 6662 - DNA, 1420 bp, Arabidopsis thaliana
  misc_feature (1)..(1420): useful for making plants with modified plant phenotypes as described in USSN 12/139,269
  misc_feature (1)..(1420): Ceres CLONE ID no. 152141
  misc_feature (1)..(1420): Also known as  Ceres CDNA ID no. 23471937
aaaatccgaaaaagaccaatcaatcctttctccctgaaatggcggcggctctgcagacgaatatccggacggtcaaggttccggctacgttcagagctgtaagtaaacagtcattggcaccctttagagtaagatgtgctgttgcttcccctgggaaaaaacgatacaccatcactctccttcccggagacggcatcggtccggaggttgtctccattgccaaaaatgtgcttcagcaagctggatctttggaaggtgtggaatttaacttccgtgagatgcccattggaggagctgctttggatttggtcggagtgcccttgccggaggagactatctcagctgcaaaagaatcagatgcagtgcttcttggagccattggagggtacaaatgggataacaatgaaaaacatctgaggcctgagaaggggttacttcagattcgtgcagctctcaaagtctttgcaaatctgagacctgctacagttctcccacagttagtggatgcttccaccttaaagagagaggtagcagaaggtgttgatctaatggttgtaagggagcttacaggaggtatttactttggagagccaaggggcataaagaccaatgaaaatggcgaggaagttgggtttaatactgaggtttatgctcacgagattgatagaattgctcgtgttgccttcgagactgctcggaaacggcgtggcaagctgtgttctgttgacaaagctaatgttttggaagcctcaatcttatggaggaaacgagtaacagcattagcctctgaatatcctgatgttgagctgtcacatatgtatgttgacaatgccgcgatgcagcttgttcgtgacccaaaacagtttgacaccatcgtcacaaacaacatttttggtgatatattatccgatgaagcttcaatgatcacaggaagcataggaatgctgccatctgctagtctcagtgattcgggacctggactctttgaacctatacatggttctgcacctgatattgctggacaggataaggcaaacccattggcaaccattctaagcgctgcaatgcttctgaaatacggacttggagaagaaaaggcagccaagagaattgaagacgcagtgttggttgctctgaacaacggattcagaactggagacatatactccgcgggaacaaaactggtgggctgcaaggagatgggagaggaggttctgaagtcagtggactcccaagttccagcttctgtttaatatttgtagaaactttgaagagttcatttccaacaacaaatgttgtaccttgtactcaaagagtctcggtttcattagcgatttttataatgtgagattattagagggacttatttgatcgaactgaaacgttggtgtttttttctgagaaataaatatccttgtgg

SEQ ID NO: 6663 - protein, 404 aa, Arabidopsis thaliana
  misc_feature (1)..(404): useful for making plants with modified plant phenotypes as described in USSN 12/139,269
  misc_feature (44)..(392): Pfam Name: Iso_dh; Pfam Description: Isocitrate/isopropylmalate dehydrogenase
  misc_feature (1)..(404): Utility: Useful for increasing chlorophyll and photosynthetic capacity
  misc_feature (1)..(404): Utility: Useful for making lethal plants for genetic confinement systems
  misc_feature (1)..(404): Utility: Useful for making smaller plants
MAAALQTNIRTVKVPATFRAVSKQSLAPFRVRCAVASPGKKRYTITLLPGDGIGPEVVSIAKNVLQQAGSLEGVEFNFREMPIGGAALDLVGVPLPEETISAAKESDAVLLGAIGGYKWDNNEKHLRPEKGLLQIRAALKVFANLRPATVLPQLVDASTLKREVAEGVDLMVVRELTGGIYFGEPRGIKTNENGEEVGFNTEVYAHEIDRIARVAFETARKRRGKLCSVDKANVLEASILWRKRVTALASEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLVALNNGFRTGDIYSAGTKLVGCKEMGEEVLKSVDSQVPASV

SEQ ID NO: 6664 - protein, 406 aa, Brassica napus
  misc_feature (1)..(406): useful for making plants with modified plant phenotypes as described in USSN 12/139,269
  misc_feature (1)..(406): Ceres CLONE ID no. 1107090
  misc_feature (1)..(406): Utility: Useful for increasing chlorophyll and photosynthetic capacity
  misc_feature (1)..(406): Utility: Useful for making lethal plants for genetic confinement systems
  misc_feature (1)..(406): Utility: Useful for making smaller plants
MAAALQTNIRPVKFPATLRALTKQSSPAPFRVRCAAASPGKKRYNITLLPGDGIGPEVISIAKNVLQQAGSLEGLEFSFQEMPVGGAALDLVGVPLPEETVSAAKESDAVLLGAIGGYKWDKNEKHLKPETGLLQLRAGLKVFANLRPATVLPQLVDASTLKREVAEGVDLMVVRELTGGIYFGVPRGIKTNENGEEVGYNTEVYAAHEIDRIARVAFETARKRRGKLCSVDKANVLDASILWRRRVTALAAEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLGALNKGFRTGDIYSAGTKLVGCKEMGEEVLKSVDSHVQASV

SEQ ID NO: 6665 - protein, 406 aa, Brassica napus; identical to SEQ ID NO: 6664
  misc_feature (1)..(406): useful for making plants with modified plant phenotypes as described in USSN 12/139,269
  misc_feature (1)..(406): Public GI no. 17827
  misc_feature (1)..(406): Utility: Useful for increasing chlorophyll and photosynthetic capacity
  misc_feature (1)..(406): Utility: Useful for making lethal plants for genetic confinement systems
  misc_feature (1)..(406): Utility: Useful for making smaller plants

SEQ ID NO: 6666 - protein, 325 aa, Arabidopsis thaliana
  misc_feature (1)..(325): useful for making plants with modified plant phenotypes as described in USSN 12/139,269
  misc_feature (1)..(325): Ceres CLONE ID no. 95686
  misc_feature (1)..(325): Utility: Useful for increasing chlorophyll and photosynthetic capacity
  misc_feature (1)..(325): Utility: Useful for making lethal plants for genetic confinement systems
  misc_feature (1)..(325): Utility: Useful for making smaller plants
MPVGGAALDLVGVPLREETFTAAKLSDAILLGAIGGYKWDKNEKHLRPEMALFYLRRDLKVFANLRPATVLPQLVDASTLKKEVAEGVDMMIVRELTGGIYFGEPRGITINENGEEVGVSTEIYAAHEIDRIARVAFETARKRRGKLCSVDKANVLDASILWRKRVTALASEYPDVELSHMYVDNAAMQLIRDPKQFDTIVTNNIFGDILSDEASMITGSIGMLPSASLGESGPGLFEPIHGSAPDIAGQDKANPLATILSAAMLLKYGLGEEKAAKRIEDAVVDALNKGFRTGDIYSPGNKLVGCKEMGEEVLKSVESKVPATV

SEQ ID NO: 6667 - protein, 404 aa, Arabidopsis thaliana
  misc_feature (1)..(404): useful for making plants with modified plant phenotypes as described in USSN 12/139,269
  misc_feature (1)..(404): Ceres CLONE ID no. 34420
  misc_feature (1)..(404): Utility: Useful for increasing chlorophyll and photosynthetic capacity
  misc_feature (1)..(404): Utility: Useful for making lethal plants for genetic confinement systems
  misc_feature (1)..(404): Utility: Useful for making smaller plants
MAAFLQTNIRLEIIPGRYSSLTDHKFRAPYRIRCAAASPVKKRYNITLLPGDGIGPEVISVAKNVLQKAGFLQGLEFDFQEMPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNAAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNKLVGCKEMGEEVLKSVDSKVPV

SEQ ID NO: 6668 - protein, 404 aa, Arabidopsis thaliana; identical to SEQ ID NO: 6667
  misc_feature (1)..(404): useful for making plants with modified plant phenotypes as described in USSN 12/139,269
  misc_feature (1)..(404): Public GI no. 15221631
  misc_feature (1)..(404): Utility: Useful for increasing chlorophyll and photosynthetic capacity
  misc_feature (1)..(404): Utility: Useful for making lethal plants for genetic confinement systems
  misc_feature (1)..(404): Utility: Useful for making smaller plants

SEQ ID NO: 6669 - protein, 406 aa, Arabidopsis thaliana
  misc_feature (1)..(406): useful for making plants with modified plant phenotypes as described in USSN 12/139,269
  misc_feature (1)..(406): Public GI no. 4512615
  misc_feature (1)..(406): Utility: Useful for increasing chlorophyll and photosynthetic capacity
  misc_feature (1)..(406): Utility: Useful for making lethal plants for genetic confinement systems
  misc_feature (1)..(406): Utility: Useful for making smaller plants
MAAFLQTNIRLEIIPGRYSSLTDHKFRAPYRIRCAAASPVKKRYNITLLPGDGIGPEVISVAKNVLQKAGFLQGLEFDFQEMPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNAAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNVCKLVGCKEMGEEVLKSVDSKVPV

SEQ ID NO: 6670 - protein, 409 aa, Arabidopsis thaliana [sequence omitted]

SEQ ID NO: 6671 - protein, 404 aa, Arabidopsis thaliana
  misc_feature (1)..(404): useful for making plants with modified plant phenotypes as described in USSN 12/139,269
  misc_feature (1)..(404): Public GI no. 21592944
  misc_feature (1)..(404): Utility: Useful for increasing chlorophyll and photosynthetic capacity
  misc_feature (1)..(404): Utility: Useful for making lethal plants for genetic confinement systems
  misc_feature (1)..(404): Utility: Useful for making smaller plants
  misc_feature (267)..(267): Xaa is any aa, unknown or other
MAAFLQTNIRLEIIPGRYSSLTDHKFRAPYRIRCAAASPVKKRYNITLLPGDGIGPEVISVAKNVLQKAGFLQGLEFDFQEMPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNXAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNKLVGCKEMGEEVLKSVDSKVPV

SEQ ID NO: 6672 - protein, 409 aa, Arabidopsis thaliana
  misc_feature (1)..(409): useful for making plants with modified plant phenotypes as described in USSN 12/139,269
  misc_feature (1)..(409): Public GI no. 18377879
  misc_feature (1)..(409): Utility: Useful for increasing chlorophyll and photosynthetic capacity
  misc_feature (1)..(409): Utility: Useful for making lethal plants for genetic confinement systems
  misc_feature (1)..(409): Utility: Useful for making smaller plants
MAAFLQTNISLNAIKIVPGKYSSLTDHQFRAPYRIRCAAASPGKKRYNIALLPGDGIGPEVISVAKNVLQKAGSLEGLEFDFKEMPVGGAALDLVGVPLPEETFTAAKLSDAILLGAIGGYKWDKNEKHLRPEMALFYLRRDLKVFANLRPATVLPQLVDASTLKKEVAEGVDMMIVRELTGGIYFGEPRGITINENGEEVGVSTEIYAAHEIDRIARVAFETARKRRGKLCSVDKANVLDASILWRKRVAALASEYPDVELSHMYVDNAAMQLIRDPKQFDTIVTNNIFGDILSDEASMITGSIGMLPSASLGESGPGLFEPIHGSAPDIAGQDKANPLATILSAAMLLKYGLGEEKAAKRIEDAVVDALNKGFRTGDIYSPGNKLVGCKEMGEEVLKSVESKVPATV

SEQ ID NO: 6673 - protein, 378 aa, Zea mays
  misc_feature (1)..(378): useful for making plants with modified plant phenotypes as described in USSN 12/139,269
  misc_feature (1)..(378): Ceres CLONE ID no. 325158
  misc_feature (1)..(378): Utility: Useful for increasing chlorophyll and photosynthetic capacity
  misc_feature (1)..(378): Utility: Useful for making lethal plants for genetic confinement systems
  misc_feature (1)..(378): Utility: Useful for making smaller plants
MAASFRCSAAARSYNITLLPGDGIGPEVVAVAKDVLSLAGALEGVELRFQEKLVGGSALDATGVPLPDETLDAAKGSDAVLLGAIGGYKWDNNEKHLKPETGLLQLRAGLGVFANLRPAAVLPQLVDASTLKKEVAEGVDIMVVRELTGGIYFGKPRGFGTNDNGDDIGFNTEVYPASEIDRIARVAFEVARKRRGRLCSVDKANVLEASMLWRKRVTALASEFPDIELSHMYVDNAAMQLVRNPKQFDTIVTNNIFGDILSDEASMITGSIGMLPSASVGESGPGLFEPIHGSAPDIAGQDKANPLATILSAAMLLRYGLGEENAANRIEAAVTETLNHGFRTGDIYSPGTTLVGCKRMGEEVLKTVNSLKEVAAVN

SEQ ID NO: 6674 - protein, 328 aa, Glycine max
  misc_feature (1)..(328): useful for making plants with modified plant phenotypes as described in USSN 12/139,269
  misc_feature (1)..(328): Ceres CLONE ID no. 545212
  misc_feature (1)..(328): Utility: Useful for increasing chlorophyll and photosynthetic capacity
  misc_feature (1)..(328): Utility: Useful for making lethal plants for genetic confinement systems
  misc_feature (1)..(328): Utility: Useful for making smaller plants
  misc_feature (240)..(240): Xaa is any aa, unknown or other
MLMGGAALDATGLPLPHETLSAAKQSHAVLLGAVGGYKWDRNDKHLKPETGLLQIRKELGVFANLRPATVYSPLVDASTLKREVAEGVDIMLIRELTGGIYFGEPRGFGTNDNGEEIGFNTEIYATHEIDRIAHFAFKVAQKRRRKLCSVDKANVLEASMLWRKRFLAIAQEYPDVELSHMYVDNASMQLIRDPKQFDTMVTNNIFGDILSDEASMVTGSIGMLPSASLGASGPGLFEPXHGSAPDIAGQDKANPFATVLSAAMLLRYGLGEEKAAERIENAVMDTLNRGFRTGDIYSAGTKLVGCKQLGEEILKSVESNVPAGAAAV

SEQ ID NO: 6675 - protein, 409 aa, Zea mays
  misc_feature (1)..(409): useful for making plants with modified plant phenotypes as described in USSN 12/139,269
  misc_feature (1)..(409): Ceres CLONE ID no. 279689
  misc_feature (1)..(409): Utility: Useful for increasing chlorophyll and photosynthetic capacity
  misc_feature (1)..(409): Utility: Useful for making lethal plants for genetic confinement systems
  misc_feature (1)..(409): Utility: Useful for making smaller plants
MAAALQATPIKTLATSRWRVEGAEARPRPRPIAVSFRCSAAARSYNITLLPGDGIGPEVVAVAKDVLSFAGALEGVELRFQEKLVGGSALDATGVPLPDETLDEAKGSDAVLLGAIGGYKWDTNEKHLKPETGLLQLRAGLGVFANLRPAAVLPQLVDASTLKKEVAEGVDIMVVRELTGGIYFGKPRGFGTNDKGDDIGFNTEVYSASEIDRIARVAFEVARKRRGKLCSVDKANVLEASMLWRKKVTALASEFPDIELSHMYVDNAAMQLVRNPKQFDTIVTNNIFGDILSDEASMITGSIGMLPSASVGESGPGLFEPIHGSAPDIAGQDKANPLATILSAAMLLRYGLGEENAARRIEAAVTETLNHGFRTGDIYSPGTTLVGCKRMGEEVLKTVESLKEVAAVN

SEQ ID NO: 6676 - DNA, 1191 bp, Arabidopsis thaliana
  misc_feature (1)..(1191): useful for making plants with modified plant phenotypes as described in USSN 12/139,269
  misc_feature (1)..(1191): Ceres CLONE ID no. 157730
  misc_feature (1)..(1191): Also known as  Ceres CDNA ID no. 23477461
gaaatcctagctgaagtctatgctccataatcaaatccagttcatcagagatcaaagatggctattgcacgaactggagtttatgttgatgattaccttgagtagctacaaagattactaaacacagttcgcgaactagacgagagatctcaatcgcttataaatcagacaagacagcaaactaagtattgcttagggcttgcttcacagagttctaaaaagggtaatggtaatcattacaataatggtggtcttgatgaagaggaaacgattgagaaaatgcgtaaagagattgagtctagtcaggaaaatgcgttaagtttgtgtaccgagaaggttttattggcccgacaagcgtatgatcttatagatagtcatgtaaaacgacttgatgaagatctgaataattttgcagaagatttaaagcaagagggaaaaattccaccagacgagccctctgttcttcctccactacctatagttcctaaagcggaaaagcgtaagtccttctatggcacacctcagcccaagaagattgattatagagatagagactgggatcgtgacagggattttgagctcatgcctcctccaggaagcaatcggaaagaccttatgccaattgaagagcagccaatcgatccaaacgaaccaacttactgtgtctgccatcaggtgtcctttggagacatgattgcctgtgacaatgagcaattgccaaggaggtgaatggtttcactatacatgcgttggcctcacacctgagaccagattcaaagggaaatggtactgccccacctgcagactcctcccacagtcacactaatatcatttgtacctgtgagaaggtgccactggcatcttctttggcaccttcccttcatgaccaatgccaccaaactcatctttcttgttacccaacatctagcaagtgcaagtagaagcaaactttagatggagaaatcatcatgttttgtaaacctcgggttaattcgtggagcatatattttgtatatcaattgtatttgggtattggtgggcattttccgttttattctactagtatcgatatttacatctgcttctttctttcttttttcccctcaaaccatgagcctttgtattgatcaaatgacatgtacaaaggttttgttcatcagaaggaatttcactaaaataaaaaattgcttg

SEQ ID NO: 6677 - protein, 15 aa, Arabidopsis thaliana
  misc_feature (1)..(15): useful for making plants with modified plant phenotypes as described in USSN 12/139,269
  misc_feature (208)..(15): Pfam Name: PHD; Pfam Description: PHD-finger
  misc_feature (208)..(15): Pfam Name: PHD; Pfam Description: PHD-finger
  misc_feature (1)..(15): Utility: Useful for increasing chlorophyll and photosynthetic capacity
  misc_feature (1)..(15): Utility: Useful for making larger plants
  misc_feature (1)..(15): Utility: Useful for making ornamental plants with modified flowers
  misc_feature (1)..(15): Utility: Useful for making plants sterile and for genetic confinement
  misc_feature (1)..(15): Utility: Useful for making taller plants and plants with longer inflorescences
MAIARTGVYVDDYLE

SEQ ID NO: 6678 - protein, 242 aa, Glycine max
  misc_feature (1)..(242): useful for making plants with modified plant phenotypes as described in USSN 12/139,269
  misc_feature (1)..(242): Ceres CLONE ID no. 537600
  misc_feature (1)..(242): Utility: Useful for increasing chlorophyll and photosynthetic capacity
  misc_feature (1)..(242): Utility: Useful for making larger plants
  misc_feature (1)..(242): Utility: Useful for making ornamental plants with modified flowers
  misc_feature (1)..(242): Utility: Useful for making plants sterile and for genetic confinement
  misc_feature (1)..(242): Utility: Useful for making taller plants and plants with longer inflorescences
MSFLEEFQANLDSLPVILQKKYALLRDLDKSLHDIQRQNEQRCEQEIEDIRRGVRSGNITPDTSVIRFSDEALDEQNHSIRVADEKVALAVQAYDLVDTHIQHLDQYLKRFGEEIRRERENAAITGVPASGSEGNTKSGRGNESGTGRGGRKKTRQTTVTPAATEAQATANPTGMDLELPVDPNEPTYCFCNQVSYGAMVACDNPNCKIEWFHFGCVGLKEQPKGKWYCSNCAATKNRRRGK

SEQ ID NO: 6679 - protein, 239 aa, Glycine max
  misc_feature (1)..(239): useful for making plants with modified plant phenotypes as described in USSN 12/139,269
  misc_feature (1)..(239): Ceres CLONE ID no. 473923
  misc_feature (1)..(239): Utility: Useful for increasing chlorophyll and photosynthetic capacity
  misc_feature (1)..(239): Utility: Useful for making larger plants
  misc_feature (1)..(239): Utility: Useful for making ornamental plants with modified flowers
  misc_feature (1)..(239): Utility: Useful for making plants sterile and for genetic confinement
  misc_feature (1)..(239): Utility: Useful for making taller plants and plants with longer inflorescences
MSFLEEFHANLDSLPVILRKKYTLLRDLDKSLQDIKRQNEQRCEQEIEDIKRGVRSGNITPDTSAIRFSDEALDEQKHSIRVADEKVALAVQAYDLVDTNIQQLDQYLKKFDEEIRRERENAAITGVPASGPEGNTKSGRGNESGTGRGGRKKTRQTTMVTEAQATSNPTGMDLELPVDPNEPTYCFCNQVSYGAMVACDNPNCKIEWFHFGCVGLKEQPKGKWYCSNCAATKNRRRSK

SEQ ID NO: 6680 - protein, 258 aa, Triticum aestivum
  misc_feature (1)..(258): useful for making plants with modified plant phenotypes as described in USSN 12/139,269
  misc_feature (1)..(258): Ceres CLONE ID no. 704991
  misc_feature (1)..(258): Utility: Useful for increasing chlorophyll and photosynthetic capacity
  misc_feature (1)..(258): Utility: Useful for making larger plants
  misc_feature (1)..(258): Utility: Useful for making ornamental plants with modified flowers
  misc_feature (1)..(258): Utility: Useful for making plants sterile and for genetic confinement
  misc_feature (1)..(258): Utility: Useful for making taller plants and plants with longer inflorescences
MAIARTGVYVDDYLEYSSTLAGDLQRILSTMHELDERAHGILGQTKGQIKYLLGVPSHGFDRPNVVHDENASEKMTRDIENSQDNALSLCTEKVLLARQAYDLIESHIKRLDEDLGQFAEDLKQEGKIPPDEPHILPPMPVGGRDERRRSSFSTPQAARKFVREKEWDRDRERGMDFDLMPPPGSSNKKAVASMDVDQMIDPNEPTYCICHQVSYGDMIACDNENCEGGEWFHYSCVGLTPETRFKGKWFCPTCRNLQ

SEQ ID NO: 6681 - protein, 243 aa, Triticum aestivum
  misc_feature (1)..(243): useful for making plants with modified plant phenotypes as described in USSN 12/139,269
  misc_feature (1)..(243): Public GI no. 50918691
  misc_feature (1)..(243): Utility: Useful for increasing chlorophyll and photosynthetic capacity
  misc_feature (1)..(243): Utility: Useful for making larger plants
  misc_feature (1)..(243): Utility: Useful for making ornamental plants with modified flowers
  misc_feature (1)..(243): Utility: Useful for making plants sterile and for genetic confinement
  misc_feature (1)..(243): Utility: Useful for making taller plants and plants with longer inflorescences
MAIARTGVYVDDYLEYSSTLAGDLQRILSTMRELDERAHGIMGQTKEQIKYLLGVPSHGFDRSNMDDDESASERMKKDIEASQDNALSLCTEKVLLARQAYDLIESHIKRLDEDLGQFAEDLKQEGKIPPDEPSILPAISAFSRDDKRRPGFSTPQATKKFREREWDRERGMDFDLMPPPGSNKKTTAPMDVDQTIDPNEPTYCICHQISYGDMIACDNDNVIIIFFTPNELYISVEQSGKLN

SEQ ID NO: 6682 - DNA, 748 bp, Zea mays
  misc_feature (1)..(748): useful for making plants with modified plant phenotypes as described in USSN 12/139,269
  misc_feature (1)..(748): Ceres CLONE ID no. 221477
  misc_feature (1)..(748): Also known as  Ceres CDNA ID no. 23741964
  misc_feature (721)..(721): r is g or a
  misc_feature (723)..(723): m is a or c
tcgctagcccagctttagtttatagcactctctcactcagtagtcagctccctccatttgtccattctccaaaggtagttagctaggttaggcacacgcgcgccactcgactagctagcagctatggagggagaagatgacggcgcccaaatgaaactgcagcaacaacaacagtcgccttgcagtgacaacttgagcttgtccgccgcctcctcatggctgccgccacaggtaaggtcgtcgtcgtcgtcgtcgtcgtacacctgcgggtattgcaagaaggagttcagatcagcacaagggctgggaggccacatgaacatccacaggctggacagggccagactgatccaccaacagtacacttcacaccgtattgctgctccccatccaaaccctaatcctagttgcacatcagttcttgaccttgagctcagcttgtcgtcgctgctagcgcatggtgctgccagcagcgacggaggcttgtctgttccagtggcaaagctggcgggcaaccgtttctcctccgcatcgctccccacgaccaaggacgtcgaggggaagaacttagagttgaggataggagcgtgcagtcatggcgatggcgcggaagagcgtctggatcttcagcttagactgggctactactgagccagacagaggaacgaactgctacaatgggtacgtgcagtgcatgatgatggaatgactggctttgtcrtmataataatgatgatccgattattgc

SEQ ID NO: 6683 - protein, 175 aa, Zea mays
  misc_feature (1)..(175): useful for making plants with modified plant phenotypes as described in USSN 12/139,269
  misc_feature (46)..(68): Pfam Name: zf-C2H2; Pfam Description: Zinc finger, C2H2 type
  misc_feature (46)..(68): Pfam Name: zf-C2H2; Pfam Description: Zinc finger, C2H2 type
  misc_feature (1)..(175): Utility: Useful for increasing chlorophyll and photosynthetic capacity
  misc_feature (1)..(175): Utility: Useful for modifying seed structure and content
MEGEDDGAQMKLQQQQQSPCSDNLSLSAASSWLPPQVRSSSSSSSYTCGYCKKEFRSAQGLGGHMNIHRLDRARLIHQQYTSHRIAAPHPNPNPSCTSVLDLELSLSSLLAHGAASSDGGLSVPVAKLAGNRFSSASLPTTKDVEGKNLELRIGACSHGDGAEERLDLQLRLGYY

SEQ ID NO: 6684 - DNA, 933 bp, Zea mays
  misc_feature (1)..(933): useful for making plants with modified plant phenotypes as described in USSN 12/139,269
  misc_feature (1)..(933): Ceres CLONE ID no. 225597
  misc_feature (1)..(933): Also known as  Ceres CDNA ID no. 23751584
  misc_feature (541)..(541): d is a or g or t/u
gcaaaaggcattcgttcgttcataaacatcgcctgaacaccaaagtcaccctccagcagtttcgctttcttgcttcaccctgcgatcgagatcgagctcaacaaccatggaggatttagtgagtagcccatctttcaggagcgtcctcagcagcagtagcgaagggcaggctcagtcaggagagagttcttggacggattacttcgtggatttcatgttatccgaggaggagaggaagagacaggcagatgctagctcatactcatactgcgctaccgaagacgaaggcgggcagcaaatacggtggcgatggaagcaaccgcgatgaggaggaggaggaagaggaggagtccatggtctccgatgccgcctctcatgcccctacgactgcaggcgccaccgcactgataccagctggcaggtacaaggagctgaagaagctcaagaaaaagcctttcggcaaagccctggaccatgacggttccctggaggatactgcgagctctccggtgaatagcccaaaggtcagtgttgtgtcacdagctggaattgagtcctaaaaggaggtgcaacatcagggacctcaccaagggagtcgttggaattggcgatgatcacggcggggaggggatggacgtctgtacagatgcaacgaccacggaaggagcgaggcttggtgatcagtaccacacgagcatagctccatgtgcggagctgaaggacaaggggatttgtttgttccccttttccgtgctgctgcactaccatgggccaaactgaggaaaaaaacaatatgcgaatgaacagcatatgtagtgtttcgcaacttacactctatgcgcgcatgcatgtgtggtatgaacgaatgcaagaagaatgtgatactgtggatatatatatgtttttccttaatgaatatatgtgaatattact

SEQ ID NO: 6685 - protein, 223 aa, Zea mays
  misc_feature (1)..(223): useful for making plants with modified plant phenotypes as described in USSN 12/139,269
  misc_feature (1)..(223): Utility: Useful for increasing chlorophyll and photosynthetic capacity
  misc_feature (1)..(223): Utility: Useful for making plants sterile and for genetic confinement
  misc_feature (1)..(223): Utility: Useful for making plants with increased biomass and foliage
  misc_feature (1)..(223): Utility: Useful for making smaller plants
  misc_feature (1)..(223): Utility: Useful for making stronger plants
MEDLVSSPSFRSVLSSSSEGQAQSGESSWTDYFVDFMLSEEERKRQADASSYSYCATEDEGGSKYGGDGSNRDEEEEEEEESMVSDAASHAPTTAGATALIPAGRYKELKKLKKKPFGKALDHDGSLEDTASSPVNSPKVSVVSQLELSPKRRCNIRDLTKGVVGIGDDHGGEGMDVCTDATTTEGARLGDQYHTSIAPCAELKDKGICLFPFSVLLHYHGPN

SEQ ID NO: 6686 - protein, 212 aa, Zea mays
  misc_feature (1)..(212): useful for making plants with modified plant phenotypes as described in USSN 12/139,269
  misc_feature (1)..(212): Public GI no. 50937881
  misc_feature (1)..(212): Utility: Useful for increasing chlorophyll and photosynthetic capacity
  misc_feature (1)..(212): Utility: Useful for making plants sterile and for genetic confinement
  misc_feature (1)..(212): Utility: Useful for making plants with increased biomass and foliage
  misc_feature (1)..(212): Utility: Useful for making smaller plants
  misc_feature (1)..(212): Utility: Useful for making stronger plants
MRSAIISCSSTSEDQQAAAAAQAQPEESTWTDYFVDFMMSEEEKKSQEDHGASSYCSHGGDGVYGDCSDQKELEEEEGEEDSMISDAASCAPAAAALPDRYKELKKLKKKVFKALDHDDSLEDTASSPVNSPKVSALTQLELSPKRRCNTRDLTKEVGIGDDRGREGMDYADAMVEGVRFVDQSQKSVTPCGELKDKGLCLFPLSMLLHYHG

SEQ ID NO: 6687 - protein, 191 aa, Triticum aestivum
  misc_feature (1)..(191): useful for making plants with modified plant phenotypes as described in USSN 12/139,269
  misc_feature (1)..(191): Ceres CLONE ID no. 839318
  misc_feature (1)..(191): Utility: Useful for increasing chlorophyll and photosynthetic capacity
  misc_feature (1)..(191): Utility: Useful for making plants sterile and for genetic confinement
  misc_feature (1)..(191): Utility: Useful for making plants with increased biomass and foliage
  misc_feature (1)..(191): Utility: Useful for making smaller plants
  misc_feature (1)..(191): Utility: Useful for making stronger plants
  misc_feature (44)..(44): Xaa is any aa, unknown or other
  misc_feature (46)..(46): Xaa is any aa, unknown or other
  misc_feature (51)..(51): Xaa is any aa, unknown or other
  misc_feature (91)..(91): Xaa is any aa, unknown or other
  misc_feature (97)..(97): Xaa is any aa, unknown or other
  misc_feature (103)..(103): Xaa is any aa, unknown or other
  misc_feature (151)..(151): Xaa is any aa, unknown or other
  misc_feature (160)..(160): Xaa is any aa, unknown or other
  misc_feature (175)..(175): Xaa is any aa, unknown or other
  misc_feature (182)..(182): Xaa is any aa, unknown or other
MDDLVSSSSLKSVLSCSEAEAQPEESSWTDYFVDFMMSEEEEKXQXASYCXFDQDDEEEGSMISDAASLAPAALADRYKGLKKLKKKVFKXLDHDDXLEDTAXSPVNSPKVSALSQLEFSPKIRCNVTDLAKGAGIGNYYGRDGIDCEDAXAVMEGVRFXDQSQRGITPCAELKXKGLCLVXLSMLLNYQG

SEQ ID NO: 6688 - DNA, 485 bp, Arabidopsis thaliana
  misc_feature (1)..(485): useful for making plants with modified plant phenotypes as described in USSN 12/139,269
  misc_feature (1)..(485): Ceres CLONE ID no. 264705
  misc_feature (1)..(485): Also known as  Ceres CDNA ID no. 23383772
actttttccggcttcattttctagctcttacaatggcttctagattcatgagcagatcctctatctcgtctctcaaatccgccattagatcttcatttcgaaattctcccattggcactggatcttctccggctgctgcttcattcgccggatttcgtattccgtctaaaccagctgcttctcctcttccccgattctccttctccaggtgtccgtcggagcttggttgtgttcagtctctgttaccgctacacagcacggtggcggctgcgcggttgacgtcatgcttaagcacaacttccagaagcagccgagctctcactcaggagatgggactttcagtcccaaggtgacaagatacattcatgaagagtattactattgagggatgcaagtttcttctctaaacttagagactagaatttgttttttgtgttatgactccaaacttatgttctttgattcatgaagggaaaaaatgtaat

SEQ ID NO: 6689 - protein, 106 aa, Arabidopsis thaliana
  misc_feature (1)..(106): useful for making plants with modified plant phenotypes as described in USSN 12/139,269
  misc_feature (1)..(106): Utility: Useful for increasing chlorophyll and photosynthetic capacity
  misc_feature (1)..(106): Utility: Useful for making smaller plants
MASRFMSRSSISSLKSAIRSSFRNSPIGTGSSPAAASFAGFRIPSKPAASPLPRFSFSRCPSELGCVQSLLPLHSTVAAARLTSCLSTTSRSSRALTQEMGLSVPR

SEQ ID NO: 6690 - protein, 100 aa, Arabidopsis thaliana
  misc_feature (1)..(100): useful for making plants with modified plant phenotypes as described in USSN 12/139,269
  misc_feature (1)..(100): Ceres CLONE ID no. 108581
  misc_feature (1)..(100): Utility: Useful for increasing chlorophyll and photosynthetic capacity
  misc_feature (1)..(100): Utility: Useful for making smaller plants
MASRFMSRSSVSSLKSAIRSSFRNSPIGTGSSPAAASFAGFRIPSKPAASPLPRFSFSRCPSELGCVQSLLPLHSTVAAARLTSCLSTTSRSSRALTQGT

SEQ ID NO: 6691 - protein, 104 aa, Arabidopsis thaliana
  misc_feature (1)..(104): useful for making plants with modified plant phenotypes as described in USSN 12/139,269
  misc_feature (1)..(104): Ceres CLONE ID no. 28462
  misc_feature (1)..(104): Utility: Useful for increasing chlorophyll and photosynthetic capacity
  misc_feature (1)..(104): Utility: Useful for making smaller plants
MASRFMSRSSVSSLKSAIRSSFRNSPIGTGSSPAAASFAGFRIPSKPAASPLPRFSFSRCPSELGCVQSLLPLHSTVAAARLTSCLSTTSRSSRALTQDGIDDT

SEQ ID NO: 6692 - protein, 104 aa, Arabidopsis thaliana; identical to SEQ ID NO: 6691
  misc_feature (1)..(104): useful for making plants with modified plant phenotypes as described in USSN 12/139,269
  misc_feature (1)..(104): Ceres CLONE ID no. 33570
  misc_feature (1)..(104): Utility: Useful for increasing chlorophyll and photosynthetic capacity
  misc_feature (1)..(104): Utility: Useful for making smaller plants

SEQ ID NO: 6693 - protein, 108 aa, Brassica napus
  misc_feature (1)..(108): useful for making plants with modified plant phenotypes as described in USSN 12/139,269
  misc_feature (1)..(108): Ceres CLONE ID no. 979674
  misc_feature (1)..(108): Utility: Useful for increasing chlorophyll and photosynthetic capacity
  misc_feature (1)..(108): Utility: Useful for making smaller plants
MASACNRFMNRSSVSSLRSAIRSSLHKSPIGTGSSPSASSAGFRIPSKPAASPRFSFSRCPSELGCAQSLLPLHSTVAAARLTSCLSVTSRNSRALSQGTLCCTSPDL

SEQ ID NO: 6694 - protein, 101 aa, Brassica napus
  misc_feature (1)..(101): useful for making plants with modified plant phenotypes as described in USSN 12/139,269
  misc_feature (1)..(101): Ceres CLONE ID no. 977919
  misc_feature (1)..(101): Utility: Useful for increasing chlorophyll and photosynthetic capacity
  misc_feature (1)..(101): Utility: Useful for making smaller plants
  misc_feature (8)..(8): Xaa is any aa, unknown or other
MASACCNXFMNRSSVSSLRSAIRSALHKSPVGTGTPPSASSAGFRIPSKPAASPRFSFSRCPSELGCVQSLLPLHSTVAAARLTSCLSVTSRSSRALSQGT

SEQ ID NO: 6695 - protein, 102 aa, Brassica napus
  misc_feature (1)..(102): useful for making plants with modified plant phenotypes as described in USSN 12/139,269
  misc_feature (1)..(102): Ceres CLONE ID no. 1068835
  misc_feature (1)..(102): Utility: Useful for increasing chlorophyll and photosynthetic capacity
  misc_feature (1)..(102): Utility: Useful for making smaller plants
MASACNRFINRSSVSSLRSAIRSSLHKSPTGIGSSSAGFRIPSKPAASPRFSFSRCPSELGCAQSLLPLHSTVAAARLTSCLSVTSRNSRALSQEMGLSVPR

SEQ ID NO: 6696 - protein, 104 aa, Brassica napus
  misc_feature (1)..(104): useful for making plants with modified plant phenotypes as described in USSN 12/139,269
  misc_feature (1)..(104): Ceres CLONE ID no. 1118546
  misc_feature (1)..(104): Utility: Useful for increasing chlorophyll and photosynthetic capacity
  misc_feature (1)..(104): Utility: Useful for making smaller plants
MASACNRFINRSSVSSLRSAIRSSLHKSPIGPGSSSAGFRIPSKPAASPRFSFSRCPSELGCAQSLLPLHSTVAAARLTSCLSVTSRNSRALSQGTLCCTSPDL

SEQ ID NO: 6697 - protein, 100 aa, Brassica napus
  misc_feature (1)..(100): useful for making plants with modified plant phenotypes as described in USSN 12/139,269
  misc_feature (1)..(100): Ceres CLONE ID no. 967899
  misc_feature (1)..(100): Utility: Useful for increasing chlorophyll and photosynthetic capacity
  misc_feature (1)..(100): Utility: Useful for making smaller plants
MASACNRFINRSSVSSLRSAVRSALHKSPIGTGTPPSASSAGFRIPSKPAASPRFSFFRCPSELGCVQSLLPLHSTVAAARLTSCLSVTSRSSRALSQGT

SEQ ID NO: 6698 - protein, 100 aa, Brassica napus
  misc_feature (1)..(100): useful for making plants with modified plant phenotypes as described in USSN 12/139,269
  misc_feature (1)..(100): Ceres CLONE ID no. 953793
  misc_feature (1)..(100): Utility: Useful for increasing chlorophyll and photosynthetic capacity
  misc_feature (1)..(100): Utility: Useful for making smaller plants
  misc_feature (29)..(29): Xaa is any aa, unknown or other
  misc_feature (30)..(30): Xaa is any aa, unknown or other
MASACNRFINRSSVSSLRSAIRSSLHKSXXGIGSSSAGFRIPSKPAASPRFSFSRCPSELGCAQSLLPLHSTVAAARLTSCLSVTSRNSRALSQDGIDGT

SEQ ID NO: 6699 - protein, 92 aa, Zea mays
  misc_feature (1)..(92): useful for making plants with modified plant phenotypes as described in USSN 12/139,269
  misc_feature (1)..(92): Ceres CLONE ID no. 1063637
  misc_feature (1)..(92): Utility: Useful for increasing chlorophyll and photosynthetic capacity
  misc_feature (1)..(92): Utility: Useful for making smaller plants
MASTCFRAAARVASAAGRSAAATRSAPSAARAAAAAHRASSFSRMPVELGCCAGLSLLPLHSAVAAARLTSRLSTASSCRALSQEMGLSVRR

SEQ ID NO: 6700 - protein, 94 aa, Glycine max
  misc_feature (1)..(94): useful for making plants with modified plant phenotypes as described in USSN 12/139,269
  misc_feature (1)..(94): Ceres CLONE ID no. 1104229
  misc_feature (1)..(94): Utility: Useful for increasing chlorophyll and photosynthetic capacity
  misc_feature (1)..(94): Utility: Useful for making smaller plants
MASACSRIAQRTSISSIKSAIKSNIRASSFSKPASSSSPLRQSLLTRISPELRCAQSMLPLHSAVAAARMTSCLSVTSRSCRALSQELGLSVPR

SEQ ID NO: 6701 - protein, 96 aa, Glycine max
  misc_feature (1)..(96): useful for making plants with modified plant phenotypes as described in USSN 12/139,269
  misc_feature (1)..(96): Ceres CLONE ID no. 604258
  misc_feature (1)..(96): Utility: Useful for increasing chlorophyll and photosynthetic capacity
  misc_feature (1)..(96): Utility: Useful for making smaller plants
MASACSRIAQRTSISSIKSAIKSNIRASSFSKPASSSSPLRQSLLTRISPELRCAQSMLPLHSAVAAARMTSCLSVTSRSCRALSQGTLCCTSPGL

SEQ ID NO: 6702 - protein, 89 aa, Glycine max
  misc_feature (1)..(89): useful for making plants with modified plant phenotypes as described in USSN 12/139,269
  misc_feature (1)..(89): Ceres CLONE ID no. 682422
  misc_feature (1)..(89): Utility: Useful for increasing chlorophyll and photosynthetic capacity
  misc_feature (1)..(89): Utility: Useful for making smaller plants
MASACSRIAQRTSISSIRSSIKSNIRASSSFSKPASSSSPLRQSLLTRISAELRCAQSMLPLHSAVAAARMTSRLSVTSRSCRALSQGT

SEQ ID NO: 6703 - protein, 97 aa, Glycine max
  misc_feature (1)..(97): useful for making plants with modified plant phenotypes as described in USSN 12/139,269
  misc_feature (1)..(97): Ceres CLONE ID no. 620922
  misc_feature (1)..(97): Utility: Useful for increasing chlorophyll and photosynthetic capacity
  misc_feature (1)..(97): Utility: Useful for making smaller plants
MASACSRIAQRTSISSIRSSIKSNIRASSSFSKPASSSSPLRQSLLTRISAELRCAQSMLPLHSAVAAARMTSRLSVTSRSCRALSQGTLCCTSPGL

SEQ ID NO: 6704 - protein, 92 aa, Glycine max
  misc_feature (1)..(92): useful for making plants with modified plant phenotypes as described in USSN 12/139,269
  misc_feature (1)..(92): Ceres CLONE ID no. 712495
  misc_feature (1)..(92): Utility: Useful for increasing chlorophyll and photosynthetic capacity
  misc_feature (1)..(92): Utility: Useful for making smaller plants
MASACSRMAQRTSISSIKSAIKSNIRASSFSKPASSSSPLRQSLLTRISPELRCAQSMLPLHSAVAAARMTSCLSVTSRSCRALSQDGIDGT

SEQ ID NO: 6705 - protein, 88 aa, Triticum aestivum
  misc_feature (1)..(88): useful for making plants with modified plant phenotypes as described in USSN 12/139,269
  misc_feature (1)..(88): Ceres CLONE ID no. 639432
  misc_feature (1)..(88): Utility: Useful for increasing chlorophyll and photosynthetic capacity
  misc_feature (1)..(88): Utility: Useful for making smaller plants
MASTCFRAAARAATAACRSAASRSMPSVGRSAARRAPLISRVPLELGCCAGMSLLPLHSAVAAARLTSRLSTASRSSSALSQDENDDT

SEQ ID NO: 6706 - protein, 93 aa, Zea mays
  misc_feature (1)..(93): useful for making plants with modified plant phenotypes as described in USSN 12/139,269
  misc_feature (1)..(93): Ceres CLONE ID no. 1489971
  misc_feature (1)..(93): Utility: Useful for increasing chlorophyll and photosynthetic capacity
  misc_feature (1)..(93): Utility: Useful for making smaller plants
MASTCFRAAARVASAASRSAAAYRSAPSAARAVATAAHRISCFSRVPVELGCCAGLSLLPLHSAVASARLTSRLSTASSCRALSQQMGQSVRR

SEQ ID NO: 6707 - DNA, 1353 bp, Glycine max
  misc_feature (1)..(1353): useful for making plants with modified plant phenotypes as described in USSN 12/139,269
  misc_feature (1)..(1353): Ceres CLONE ID no. 464504
  misc_feature (1)..(1353): Also known as  Ceres CDNA ID no. 23670902
  misc_feature (976)..(976): y is t/u or c
  misc_feature (1000)..(1000): m is a or c
  misc_feature (1005)..(1005): y is t/u or c
  misc_feature (1009)..(1009): m is a or c
  misc_feature (1070)..(1070): m is a or c
  misc_feature (1113)..(1113): y is t/u or c
  misc_feature (1233)..(1233): k is g or t/u
gactcaaccaattccaaattctcaactttcctaactttagcaaccatctaagaagttcagtcccttaattatctctcaccttgaattagaaaagcattcaaagctttgaacccaatttcactgtttgcacctcaaacatcttagaagtcccaattgagtctcaattccacaaccaaaaatgcaaagttcaatttcacaatctgatatttttatcactgattaccttgtaccccaagaagttccatttcaatttcaatttcaagatatgagcaagaatgacaacaacatgccaatgaaccataccaataataaccttcaaatgcctcaaatcacatctttctccaagcctccaaggtcctcatcaaatctaagcaaccgcaaaccctccttgaaaaacatcacaatcccttccataacctctggtcttgcaacagctatgtcacaaacaacagcaacaacaacaacaatagctacaaccatgtataacaacaaccaagtttcttcttcttctttttcttcagatgaaaccaacaataccaaagacgacaagcactatagaggggttagaagaaggccatgggggaagtatgctgcagaaatccgtgaccctaatagaaaaggttcaagggtgtggcttggaacctttgacacagccatagaagctgctaaggcttatgacaaagctgctttcaagatgagagggagcaaagccatattgaacttccctttggagattggatcagatcagtctaaagaagagtcatcatcatcatcatcatcagtttcaagcagcagcatcgtcatcaaggttggtgtgaagagagaaagagaggaagagagtgaaaggaagaacaactatgagaaaagtgagtttaacaacaatagtaatagtaataagcatgtgaagaaagaagagtgccctttgactccatcatgttggaaaggcttttgggacactgatgttatgggaacaatytttagtgtgcctcctttgtcaccmctatytccmctaatggttgtttgagattttgtggaacttttgctctttcaatgatgttttgaggtaaccmaactaaggggagagagagagatgatgctggtgattgtcctctytgatttaggttgctaatttgcctaaatcaaaatggtagtactaattaatctactaatagattaatttgcaagtgaatatatatatggatttgtataatgtaaatataggatagtactatkaagcaagatctttttgtttgttgaaaaaaaaaacaaaaaacccatgcttatcttcttcctttaggtaaaaaaatgtactgtacttgaagcaatattgaaatttgtttattcgtttattgg

SEQ ID NO: 6708 - protein, 281 aa, Glycine max; identical to SEQ ID NO: 2303
  misc_feature (1)..(281): useful for making plants with modified plant phenotypes as described in USSN 12/139,269
  misc_feature (124)..(188): Pfam Name: AP2; Pfam Description: AP2 domain
  misc_feature (124)..(188): Pfam Name: AP2; Pfam Description: AP2 domain
  misc_feature (1)..(281): Utility: Useful for increasing chlorophyll and photosynthetic capacity
  misc_feature (1)..(281): Utility: Useful for making shorter plants and plants with modified flowers
  misc_feature (1)..(281): Utility: Useful for making smaller plants

SEQ ID NO: 6709 - DNA, 1816 bp, Glycine max
  misc_feature (1)..(1816): useful for making plants with modified plant phenotypes as described in USSN 12/139,269
  misc_feature (1)..(1816): Ceres CLONE ID no. 627596
  misc_feature (1)..(1816): Also known as  Ceres CDNA ID no. 23702084
  misc_feature (1482)..(1482): y is t/u or c
  misc_feature (1493)..(1493): m is a or c
  misc_feature (1504)..(1504): y is t/u or c
  misc_feature (1606)..(1606): y is t/u or c
  misc_feature (1659)..(1659): y is t/u or c
  misc_feature (1693)..(1693): y is t/u or c
cacagcccttctaaaacgcccttctaaaacgccttacttacttactctgtgccttctttcatcatccaaaaaagaaaaccgttggcattcacacaaagaaaacctttgggtttcccaaaatgtcatcatcggaactctcctctttctttcttctccgtctatcagacatactcagtttcgatgttttgctcggagttatgtttctagttgccgtgttcggctactggctggttcccggcggttttgcttgggctttttccaagttcaagcccgcgattcccgggccttccggttacccggtggtgggtctggtttgggctttcatagggcctcttactcacagggtccttgctaagttggctgaaacctttgatgcaaagcccttgatggcgttctctgtggggttcactcgtttcatcatctcttctcaccccgacaccgccaaagagatcttgaacagttccgctttcgcggatcgtcccgttaaggaatctgcttatgaacttctctttcaccgtgcgatggggtttgcaccctacggtgagtactggaggaacctgaggaggatctccgcaactcacatgttctctccgaggagaatcgcagcccaaggagtgtttcgggcccggattggagcccaaatggtgagagacatcgtgggcctgatggggagggacggtgtggtggaggtgaggaaggtgttgcattttgggtcgttgaataacgtgatgaagagcgtgtttgggaggagttatgtgtttggtgaggggggtgatgggtgtgagctcgaggggttggtgagcgaggggtatcatttgcttggggtgtttaactggagtgaccactttccactcttgggttggttggatttgcaaggtgtgaggaagagctgtaggagtttggttgatagagtgaatgtttatgttgggaaaatcattttggagcatagagtgaagagggttgctcaaggtgaggataataaggccattgatactgatagttctggtgactttgttgatgtgctgctggatttggagaaagagaataggctaaaccactctgatatggttgctgttttgtgggaaatgatatttagagggactgatacggtagctatccttctagagtggattctagcaagaatggttcttcatccagaaatacaagcaaaggcacaatctgaaatagactctgtggttgggtctgggcgtagtgtgagtgatgatgaccttccaaaccttccttacgttcgagccatagtgaaggaaaccttaaggatgcacccaccaggccctcttctttcatgggccagactttctattcatgacacacaaattggcaatcactttgttccagctggcaccactgctatggtaaacatgtgggccataactcacgaccaagaagtgtggtatgagccaaaacagttcaagccggagcgttttttgaaggacgaggacgtgccaatcatgggatctgatyttaggttggcmccttttggctytgggaggagagtgtgccctggaaaagccatgggcttggccactgttgagctttggcttgctatgttcttacaaaaattcaaatggatgccctgtgatgattytggtgttgacttgtctgagtgtttgaagctctccatggagatgaaacactctytcaaaaccaaagttgttgcaaggcctgtagtttytcttgcaatgtaatgggttggagtatcccatccttttactcccattaataataatattcctttccgttgtaaaaaaaaaaaaaaaaaacggcacgagaagccggcacgagaagccggcacgag

SEQ ID NO: 6710 - protein, 528 aa, Glycine max
  misc_feature (1)..(528): useful for making plants with modified plant phenotypes as described in USSN 12/139,269
  misc_feature (53)..(520): Pfam Name: p450; Pfam Description: Cytochrome P450
  misc_feature (1)..(528): Utility: Useful for increasing chlorophyll and photosynthetic capacity
  misc_feature (1)..(528): Utility: Useful for making ornamental plants with modified flowers
  misc_feature (1)..(528): Utility: Useful for making plants sterile and for genetic confinement
  misc_feature (1)..(528): Utility: Useful for making smaller plants
  misc_feature (1)..(528): Utility: Useful for making stronger plants
MSSSELSSFFLLRLSDILSFDVLLGVMFLVAVFGYWLVPGGFAWAFSKFKPAIPGPSGYPVVGLVWAFIGPLTHRVLAKLAETFDAKPLMAFSVGFTRFIISSHPDTAKEILNSSAFADRPVKESAYELLFHRAMGFAPYGEYWRNLRRISATHMFSPRRIAAQGVFRARIGAQMVRDIVGLMGRDGVVEVRKVLHFGSLNNVMKSVFGRSYVFGEGGDGCELEGLVSEGYHLLGVFNWSDHFPLLGWLDLQGVRKSCRSLVDRVNVYVGKIILEHRVKRVAQGEDNKAIDTDSSGDFVDVLLDLEKENRLNHSDMVAVLWEMIFRGTDTVAILLEWILARMVLHPEIQAKAQSEIDSVVGSGRSVSDDDLPNLPYVRAIVKETLRMHPPGPLLSWARLSIHDTQIGNHFVPAGTTAMVNMWAITHDQEVWYEPKQFKPERFLKDEDVPIMGSDLRLAPFGSGRRVCPGKAMGLATVELWLAMFLQKFKWMPCDDSGVDLSECLKLSMEMKHSLKTKVVARPVVSLAM

SEQ ID NO: 6711 - protein, 537 aa, Glycine max
  misc_feature (1)..(537): useful for making plants with modified plant phenotypes as described in USSN 12/139,269
  misc_feature (1)..(537): Public GI no. 12325138
  misc_feature (1)..(537): Utility: Useful for increasing chlorophyll and photosynthetic capacity
  misc_feature (1)..(537): Utility: Useful for making ornamental plants with modified flowers
  misc_feature (1)..(537): Utility: Useful for making plants sterile and for genetic confinement
  misc_feature (1)..(537): Utility: Useful for making smaller plants
  misc_feature (1)..(537): Utility: Useful for making stronger plants
MTIDMYLSFASRSGSSPFPSLELCLSIFLFISLFVFWLTPGGFAWALYKARFHTRPESKTGPAIPGPSGLPIFGLLLAFVNNALTHRILANIADTCKAKALMAFSVGSTRFVITSEPETAKELLNSSAFADRPVKESAYELLFDRAMGFAPFGDYWRELRRISSTHLFSPKRIFSSGESRRKIGQNMVGEIKNAMECYGEVHIKKILHFGSLNNVMSSVFGKTYNFNEGIVYSKESNELEHLVSEGYELLGIFNWSDHFPGMRWLDLQGVRRRCRSLVGRVNVFVGKIINDHKSKRSLRDNPEESTYDDDFVDVLLGMHGNSKLSDSDMIAVLWEMIFRGTDTVAILLEWILARMVLHPDIQAKAQAEIDCIVGDSGRQVTDSDLPKLPYVRAIVKETLRMHPPGPLLSWARLSIHDTQIGTHFIPAGTTAMVNMWAITHDEKVWPEAHEYKPERFLGAQESNNFPIMGSDLRLAPFGAGRRVCPGKSMGLATVELWLAQLLGSYKWVSCGEVDLSETLKLSLEMKNTLVCKAIPRG

SEQ ID NO: 6712 - protein, 517 aa, Arabidopsis thaliana
  misc_feature (1)..(517): useful for making plants with modified plant phenotypes as described in USSN 12/139,269
  misc_feature (1)..(517): Ceres CLONE ID no. 1152303
  misc_feature (1)..(517): Utility: Useful for increasing chlorophyll and photosynthetic capacity
  misc_feature (1)..(517): Utility: Useful for making ornamental plants with modified flowers
  misc_feature (1)..(517): Utility: Useful for making plants sterile and for genetic confinement
  misc_feature (1)..(517): Utility: Useful for making smaller plants
  misc_feature (1)..(517): Utility: Useful for making stronger plants
MSPEAYVLFFNSFNLVTFEAFASVSLIIATVAFLLSPGGLAWAWTGSSKSRVSIPGPSGSLSVFSGSNPHRVLAALAKRFKASPLMAFSVGFSRFVISSEPETAKEILSSSAFADRPVKESAYELLFHRAMGFAPYGEYWRNLRRISSTHLFSPRRIASFEGVRVGIGMKMVKKIKSLVTSDACGEVEVKKIVHFGSLNNVMTTVFGESYDFDEVNGKGCFLERLVSEGYELLGIFNWSDHFWFLRWFDFQGVRKRCRALVSEVNTFVGGIIEKHKMKKGNNLNGEENDFVDVLLGLQKDEKLSDSDMIAVLWEMIFRGTDTVAILVEWVLARMVLHQDIQDKLYREIASATSNNIRSLSDSDIPKLPYLQAIVKETLRLHPPGPLLSWARLAIHDVHVGPNLVPAGTIAMVNMWSITHNAKIWTDPEAFMPERFISEDVSIMGSDLRLAPFGSGRRVCPGKAMGLATVHLWIGQLIQNFEWVKGSCDVELAEVLKLSMEMKNPLKCKAVPRNVGFA

SEQ ID NO: 6713 - protein, 517 aa, Arabidopsis thaliana; identical to SEQ ID NO: 6712
  misc_feature (1)..(517): useful for making plants with modified plant phenotypes as described in USSN 12/139,269
  misc_feature (1)..(517): Public GI no. 15222937
  misc_feature (1)..(517): Utility: Useful for increasing chlorophyll and photosynthetic capacity
  misc_feature (1)..(517): Utility: Useful for making ornamental plants with modified flowers
  misc_feature (1)..(517): Utility: Useful for making plants sterile and for genetic confinement
  misc_feature (1)..(517): Utility: Useful for making smaller plants
  misc_feature (1)..(517): Utility: Useful for making stronger plants

SEQ ID NO: 6714 - protein, 385 aa, Triticum aestivum
  misc_feature (1)..(385): useful for making plants with modified plant phenotypes as described in USSN 12/139,269
  misc_feature (1)..(385): Ceres CLONE ID no. 796158
  misc_feature (1)..(385): Utility: Useful for increasing chlorophyll and photosynthetic capacity
  misc_feature (1)..(385): Utility: Useful for making ornamental plants with modified flowers
  misc_feature (1)..(385): Utility: Useful for making plants sterile and for genetic confinement
  misc_feature (1)..(385): Utility: Useful for making smaller plants
  misc_feature (1)..(385): Utility: Useful for making stronger plants
MGFAPSGDAHWRALRRLAAAHLFGPRRVAASAPHRSSIGTRMLGDVASLMARHGEVAPRRFLHAASLNHVMAVVFGKRYDDFTSQEGVVVEEMVNEGYDLLGTFNWADHLPFLKWLDLQGVRRRCNRLVRQVEAYVGNIIQEHKARRASGSGIADELSGDFVDVLLGLDGEDKMSESDMIAVLWEMIFRGTDTVAILMEWIMARMVLHPEIQSKARAELDAVVGRGRAVMDEDVARLPYIQCIVKETLRMHPPGPLLSWARLAVHDAHVGGHLVPAGTTAMVNMWAIAHDAAVWPEPELFRPERFMEEEVSVLGSDLRLAPFGAGRRVCPGKMLALATVHLWLAQLLHRFEWAPATAASGGVDLSERLKMSLEMATPLVCRAVAR

SEQ ID NO: 6715 - protein, 515 aa, Triticum aestivum
  misc_feature (1)..(515): useful for making plants with modified plant phenotypes as described in USSN 12/139,269
  misc_feature (1)..(515): Public GI no. 50916627
  misc_feature (1)..(515): Utility: Useful for increasing chlorophyll and photosynthetic capacity
  misc_feature (1)..(515): Utility: Useful for making ornamental plants with modified flowers
  misc_feature (1)..(515): Utility: Useful for making plants sterile and for genetic confinement
  misc_feature (1)..(515): Utility: Useful for making smaller plants
  misc_feature (1)..(515): Utility: Useful for making stronger plants
MDATLGASTTHGYLLLLPANSTTFFSPLLAALLAVTSLLWLVPGGPAWALSRCRRPPPGAPGALAALAGPAAHRALAAMSRSVPGGAALASFSVGLTRFVVASRPDTARELLSSAAFADRPVKDAARGLLFHRAMGFAPSGDYWRALRRVSANHLFTPRRVAASAPRRLAIGERMLDRLSALAGGEIGMRRVLHAASLDHVMDTVFGTRYDGDSQEGAELEAMVKEGYDLLGMFNWGDHLPLLKWLDLQGVRRRCRTLVQRVDVFVRSIIDEHRQRKRRTGGNGGGEELPGDFVDVLLGLQGEEKMTESDMVAVLWEMIFRGTDTVAILLEWIMARMVLHPDIQAKAQAELDAVVGRGRAVSDGDVAGLRYLQCVVKEALRVHPPGPLLSWARLAVRDAHVGGHVVPAGTTAMVNMWAIAHDPELWPEPDEFRPERFAEEDVSVLGGDLRLAPFGAGRRACPGKTLALATVHLWLAQLLHRFEWAPVGGGVHLLERLNMSLEMEKPLVCKAKPRW

SEQ ID NO: 6716 - protein, 525 aa, Triticum aestivum
  misc_feature (1)..(525): useful for making plants with modified plant phenotypes as described in USSN 12/139,269
  misc_feature (1)..(525): Public GI no. 50939101
  misc_feature (1)..(525): Utility: Useful for increasing chlorophyll and photosynthetic capacity
  misc_feature (1)..(525): Utility: Useful for making ornamental plants with modified flowers
  misc_feature (1)..(525): Utility: Useful for making plants sterile and for genetic confinement
  misc_feature (1)..(525): Utility: Useful for making smaller plants
  misc_feature (1)..(525): Utility: Useful for making stronger plants
MALSSMAAAQESSLLLFLLPTSAASVFPPLISVVVLAALLLWLSPGGPAWALSRCRGTPPPPGVAGGAASALSGPAAHRVLAGISRAVEGGAAVMSLSVGLTRLVVASRPETAREILVSPAFGDRPVKDAARQLLFHRAMGFAPSGDAHWRGLRRASAAHLFGPRRVAGSAPEREAIGARIVGDVASLMSRRGEVPLRRVLHAASLGHVMATVFGKRHGDISIQDGELLEEMVTEGYDLLGKFNWADHLPLLRWLDLQGIRRRCNRLVQKVEVFVGKIIQEHKAKRAAGGVAVADGVLGDFVDVLLDLQGEEKMSDSDMIAVLWEMIFRGTDTVAILMEWVMARMVMHPEIQAKAQAEVDAAVGGRRGRVADGDVASLPYIQSIVKETLRMHPPGPLLSWARLAVHDARVGGHAVPAGTTAMVNMWAIAHDAAVWPEPDAFRPERFSEGEDVGVLGGDLRLAPFGAGRRVCPGRMLALATAHLWLAQLLHAFDWSPTAAGVDLSERLGMSLEMAAPLVCKAVARA

SEQ ID NO: 6717 - protein, 523 aa, Triticum aestivum; identical to SEQ ID NO: 22
  misc_feature (1)..(523): useful for making plants with modified plant phenotypes as described in USSN 12/139,269
  misc_feature (1)..(523): Public GI no. 2739008
  misc_feature (1)..(523): Utility: Useful for increasing chlorophyll and photosynthetic capacity
  misc_feature (1)..(523): Utility: Useful for making ornamental plants with modified flowers
  misc_feature (1)..(523): Utility: Useful for making plants sterile and for genetic confinement
  misc_feature (1)..(523): Utility: Useful for making smaller plants
  misc_feature (1)..(523): Utility: Useful for making stronger plants

SEQ ID NO: 6718 - protein, 552 aa, Triticum aestivum; identical to SEQ ID NO: 27
  misc_feature (1)..(552): useful for making plants with modified plant phenotypes as described in USSN 12/139,269
  misc_feature (1)..(552): Ceres CLONE ID no. 779234
  misc_feature (1)..(552): Utility: Useful for increasing chlorophyll and photosynthetic capacity
  misc_feature (1)..(552): Utility: Useful for making ornamental plants with modified flowers
  misc_feature (1)..(552): Utility: Useful for making plants sterile and for genetic confinement
  misc_feature (1)..(552): Utility: Useful for making smaller plants
  misc_feature (1)..(552): Utility: Useful for making stronger plants

SEQ ID NO: 6719 - protein, 530 aa, Triticum aestivum; identical to SEQ ID NO: 20
  misc_feature (1)..(530): useful for making plants with modified plant phenotypes as described in USSN 12/139,269
  misc_feature (1)..(530): Public GI no. 20197777
  misc_feature (1)..(530): Utility: Useful for increasing chlorophyll and photosynthetic capacity
  misc_feature (1)..(530): Utility: Useful for making ornamental plants with modified flowers
  misc_feature (1)..(530): Utility: Useful for making plants sterile and for genetic confinement
  misc_feature (1)..(530): Utility: Useful for making smaller plants
  misc_feature (1)..(530): Utility: Useful for making stronger plants

SEQ ID NO: 6720 - protein, 553 aa, Triticum aestivum; identical to SEQ ID NO: 4
  misc_feature (1)..(553): useful for making plants with modified plant phenotypes as described in USSN 12/139,269
  misc_feature (1)..(553): Public GI no. 5921925
  misc_feature (1)..(553): Utility: Useful for increasing chlorophyll and photosynthetic capacity
  misc_feature (1)..(553): Utility: Useful for making ornamental plants with modified flowers
  misc_feature (1)..(553): Utility: Useful for making plants sterile and for genetic confinement
  misc_feature (1)..(553): Utility: Useful for making smaller plants
  misc_feature (1)..(553): Utility: Useful for making stronger plants

SEQ ID NO: 6721 - protein, 534 aa, Arabidopsis thaliana; identical to SEQ ID NO: 17
  misc_feature (1)..(534): useful for making plants with modified plant phenotypes as described in USSN 12/139,269
  misc_feature (1)..(534): Ceres CLONE ID no. 29661
  misc_feature (1)..(534): Utility: Useful for increasing chlorophyll and photosynthetic capacity
  misc_feature (1)..(534): Utility: Useful for making ornamental plants with modified flowers
  misc_feature (1)..(534): Utility: Useful for making plants sterile and for genetic confinement
  misc_feature (1)..(534): Utility: Useful for making smaller plants
  misc_feature (1)..(534): Utility: Useful for making stronger plants

SEQ ID NO: 6722 - protein, 515 aa, Zea mays
  misc_feature (1)..(515): useful for making plants with modified plant phenotypes as described in USSN 12/139,269
  misc_feature (1)..(515): Ceres CLONE ID no. 689576
  misc_feature (1)..(515): Utility: Useful for increasing chlorophyll and photosynthetic capacity
  misc_feature (1)..(515): Utility: Useful for making ornamental plants with modified flowers
  misc_feature (1)..(515): Utility: Useful for making plants sterile and for genetic confinement
  misc_feature (1)..(515): Utility: Useful for making smaller plants
  misc_feature (1)..(515): Utility: Useful for making stronger plants
  misc_feature (45)..(45): Xaa is any aa, unknown or other
  misc_feature (46)..(46): Xaa is any aa, unknown or other
  misc_feature (206)..(206): Xaa is any aa, unknown or other
  misc_feature (319)..(319): Xaa is any aa, unknown or other
  misc_feature (326)..(326): Xaa is any aa, unknown or other
  misc_feature (367)..(367): Xaa is any aa, unknown or other
  misc_feature (372)..(372): Xaa is any aa, unknown or other
  misc_feature (374)..(374): Xaa is any aa, unknown or other
MASAACSCTDGTWWVYALPALLGSDTLCAHPALLAGLIFLATVSXXLLAWATSPGGPAWTNGRGRLGVTPIVGPRGLPVFGSIFALSRGLPHRALAEMARAAGPRAKELMAFSVGDTPAVVSSCPATAREVLAHPSFADRPVKRSARELMFARAIGFAPNGEYWRRLRRVASTHLFSPRRVASHEPGRQGDAEAMLRSIAAEQSAXGAVALRPHLQAAALNNIMGSVFGTRYDVTSGAGAAEAEHLKSMVREGFELLGAFNWSDHLPWLAHLYDPSNVTRRCAALVPRVQTFVRGVIDEHRRRRQNSAALNDNADFVDXLLSLEGXEKLGDDDMVAILWEMVFRGTDTTTLLTEWCMAELVRHPAVXARVRXEXDAAVGAGGCPTDADVARMPYLQAVVKETLRAHPPGPLLSWARLATADVPLCNGMVVPAGTTAMVNMWAITHDAAVWADPDAFAPERFLPSGGGADVDVRGVDLRLAPFGAGASRLPRQEPGPHHRGPLGCPPRARLPVGPA

SEQ ID NO: 6723 - DNA, 533 bp, Triticum aestivum
  misc_feature (1)..(533): useful for making plants with modified plant phenotypes as described in USSN 12/139,269
  misc_feature (1)..(533): Ceres CLONE ID no. 729085
  misc_feature (1)..(533): Also known as  Ceres CDNA ID no. 13547035
  misc_feature (505)..(505): s is g or c
gactcggacaccggtcactggacagcacggcatctgctctctcgcccctcgaaatatcccaagctccaaagcccaaagcatcgatcagagccgatcaaatatagtatttcttgagcactactagctagagagaagtattctcgtgttgctgttagcctgctttactggaaagatgagccccgaggagggagagaggctcttgttcccttccttcgtcttcccggacggtttcccggcggacgacgccacaccagccgtctccggtggagagcagaagaaggccggccggcagcggcggcggaggagggcgaggcaggcagcggcaggcgaaggcgcgggaggggacgatgcggcgaagaaacgccggctgagtgacgagcaggcgcagttcctggagatgagcttcaggaaggaacgtaaactggaaacgccccgcaaggtgcagctcgccgcggagctgggcctggacaccaagcaggtcgcggtgtggttccagaaccgccgsgcccgctacaagagcaagctcatcgagg

SEQ ID NO: 6724 - protein, 120 aa, Triticum aestivum
  misc_feature (1)..(120): useful for making plants with modified plant phenotypes as described in USSN 12/139,269
  misc_feature (62)..(116): Pfam Name: Homeobox; Pfam Description: Homeobox domain
  misc_feature (1)..(120): Utility: Useful for increasing chlorophyll and photosynthetic capacity
  misc_feature (1)..(120): Utility: Useful for making shorter plants and plants with modified flowers
  misc_feature (1)..(120): Utility: Useful for making smaller plants
  misc_feature (111)..(111): Xaa is any aa, unknown or other
MSPEEGERLLFPSFVFPDGFPADDATPAVSGGEQKKAGRQRRRRRARQAAAGEGAGGDDAAKKRRLSDEQAQFLEMSFRKERKLETPRKVQLAAELGLDTKQVAVWFQNRXARYKSKLIE

SEQ ID NO: 6725 - protein, 92 aa, Triticum aestivum
  misc_feature (1)..(92): useful for making plants with modified plant phenotypes as described in USSN 12/139,269
  misc_feature (1)..(92): Ceres CLONE ID no. 901184
  misc_feature (1)..(92): Utility: Useful for increasing chlorophyll and photosynthetic capacity
  misc_feature (1)..(92): Utility: Useful for making shorter plants and plants with modified flowers
  misc_feature (1)..(92): Utility: Useful for making smaller plants
MSSEEGERLLFPSFVFPDSFPADDATPVVSGGEQKKAGRQRRRRRARQAASGEGGGDDAAKKRRLSDEQAQFLEMNFRKERKLETPRKVQLA

SEQ ID NO: 6726 - protein, 224 aa, Triticum aestivum
  misc_feature (1)..(224): useful for making plants with modified plant phenotypes as described in USSN 12/139,269
  misc_feature (1)..(224): Public GI no. 46242609
  misc_feature (1)..(224): Utility: Useful for increasing chlorophyll and photosynthetic capacity
  misc_feature (1)..(224): Utility: Useful for making shorter plants and plants with modified flowers
  misc_feature (1)..(224): Utility: Useful for making smaller plants
LSLFCLVGCCVAGGEQKKARQRRRRKVKPEAAAALAGESGGDEQAKKRRLSDEQARFLEMSFKKERKLETPRKVQLAAELGLDAKQVAVWFQNRRARHKSKLMEEEFAKLRSAHDAVVLQNCHLETELLKLKERLADVEEEKAKLAAVAAATTGGGGGGGGGSSSPTSSSFSTVTYHPVLAGQFGVEAAAEEADLTYMSEYAYNSYMLELAAAGYCGGVYDQFS

SEQ ID NO: 6727 - protein, 239 aa, Zea mays
  misc_feature (1)..(239): useful for making plants with modified plant phenotypes as described in USSN 12/139,269
  misc_feature (1)..(239): Ceres CLONE ID no. 324157
  misc_feature (1)..(239): Utility: Useful for increasing chlorophyll and photosynthetic capacity
  misc_feature (1)..(239): Utility: Useful for making shorter plants and plants with modified flowers
  misc_feature (1)..(239): Utility: Useful for making smaller plants
MGCEEEERLLFPSFVFPESFAEAATPGSGGEQKKARQRRRRKPRPAEGGEGADEQARKRRLSDDQARFLELSFRKERKLETPRKVQLAADLGLDAKQVAVWFQNRRARHKSKLMEEEFSKLRAAHDAVVLHNCHLETELLKMKDRLAEVEEEKTKLVAAAAAAAGGAAGAGSSSPSSSSFSTVTHHPAAALQVGQFGVEPEEAADLAYMTEYAYNSYMNMMDLAPGYFGGVVYDYDHFN

SEQ ID NO: 6728 - protein, 140 aa, Zea mays
  misc_feature (1)..(140): useful for making plants with modified plant phenotypes as described in USSN 12/139,269
  misc_feature (1)..(140): Ceres CLONE ID no. 1565969
  misc_feature (1)..(140): Utility: Useful for increasing chlorophyll and photosynthetic capacity
  misc_feature (1)..(140): Utility: Useful for making shorter plants and plants with modified flowers
  misc_feature (1)..(140): Utility: Useful for making smaller plants
  misc_feature (57)..(57): Xaa is any aa, unknown or other
  misc_feature (58)..(58): Xaa is any aa, unknown or other
  misc_feature (109)..(109): Xaa is any aa, unknown or other
  misc_feature (110)..(110): Xaa is any aa, unknown or other
MGYEEEDRLLFPSSVFTESFTEAAATATTPGSGSEQTKARQLSDGQARKRRLSDGHXXFLELSFGKERKLETPRKVQLAAELGLDAKQVAVWFQNRRARHKSKLMEEEXXSLRAAHDAAVLHNCHLETEVVGQCTTPSRR

SEQ ID NO: 6729 - protein, 240 aa, Zea mays
  misc_feature (1)..(240): useful for making plants with modified plant phenotypes as described in USSN 12/139,269
  misc_feature (1)..(240): Public GI no. 45593100
  misc_feature (1)..(240): Utility: Useful for increasing chlorophyll and photosynthetic capacity
  misc_feature (1)..(240): Utility: Useful for making shorter plants and plants with modified flowers
  misc_feature (1)..(240): Utility: Useful for making smaller plants
MDRYGEKQQQQQMFASYVDASLLAASGEVQGERPRARRRRRRGARCVGGGGGGGEVDGGDPKKRRLSDEQVEMLELSFREERKLETGRKVHLASELGLDPKQVAVWFQNRRARHKSKLLEEEFSKLKHAHDAAILHKCHLENEVLRLKERLVVAEEEVRRLRSAAGSHTASGEGGDIMGLGGSGACVAGSPSSSFWTGTCQPPSFGGGDPFGDDDLVYVPEYGGYADNSVVEWFSLYGLI

SEQ ID NO: 6730 - protein, 240 aa, Zea mays
  misc_feature (1)..(240): useful for making plants with modified plant phenotypes as described in USSN 12/139,269
  misc_feature (1)..(240): Public GI no. 50938719
  misc_feature (1)..(240): Utility: Useful for increasing chlorophyll and photosynthetic capacity
  misc_feature (1)..(240): Utility: Useful for making shorter plants and plants with modified flowers
  misc_feature (1)..(240): Utility: Useful for making smaller plants
MDRYGEKQQQQQMFASYVDASLLAASGEVQGERPRARRRRRRGARCVGGGGGGGEVDGGDPKKRRLSDEQVEMLELSFREERKLETGRKVHLASELGLDPKQVAVWFQNRRARHKSKLLEEEFSKLKHAHDAAILHKCHLENEVLRLKERLVVAEEEVRRLRSAAGSHTASGEGGDIMGLGGSGACVAGSPSSSFSTGTCQPPSFGGGDHLGDDDLVYVPEYGGYADNSVVEWFSLYGLI

SEQ ID NO: 6731 - protein, 234 aa, Zea mays
  misc_feature (1)..(234): useful for making plants with modified plant phenotypes as described in USSN 12/139,269
  misc_feature (1)..(234): Ceres CLONE ID no. 1440579
  misc_feature (1)..(234): Utility: Useful for increasing chlorophyll and photosynthetic capacity
  misc_feature (1)..(234): Utility: Useful for making shorter plants and plants with modified flowers
  misc_feature (1)..(234): Utility: Useful for making smaller plants
MEQYDGLFPPAYVDDSSSLLLVPNANGTAQEERPRARRRRRRAARCGGGGGELDGGGDHKKRRLTDEQVEMLELSFREERKLETGRKVHLAAELGLDPKQVAVWFQNRRARHKSKLLEEEFAKLKQAHDAAILHKCHLENEVMRLKDKLVLAEEELTRFRSAGNHAVSGDGGDVMARAVCSGSPSSSFSTGTCQQPGGGGGGGDHLGDDDLLYVPDYAYADSSVVEWFSLYGLM

SEQ ID NO: 6732 - protein, 205 aa, Glycine max
  misc_feature (1)..(205): useful for making plants with modified plant phenotypes as described in USSN 12/139,269
  misc_feature (1)..(205): Ceres CLONE ID no. 527229
  misc_feature (1)..(205): Utility: Useful for increasing chlorophyll and photosynthetic capacity
  misc_feature (1)..(205): Utility: Useful for making shorter plants and plants with modified flowers
  misc_feature (1)..(205): Utility: Useful for making smaller plants
MMLMSQLFPADAYTQIISQQGETNKKPRRRRNKKNKGGENGASEANKKRKLSEVQVNLLEQNFGNERKLESERKDRLAMELGLDPRQVAVWFQNRRARWKNKKLEEEYSSLKKNHEATLLEKCCLESEVLKLKEQLSEAEKEIQRLLESAERVPSNSSSSSQSQSMEAVDPPFFGEFGVDGYEDDVFYVPETHYINGMEWINLYM

SEQ ID NO: 6733 - protein, 208 aa, Arabidopsis thaliana
  misc_feature (1)..(208): useful for making plants with modified plant phenotypes as described in USSN 12/139,269
  misc_feature (1)..(208): Ceres CLONE ID no. 1351153
  misc_feature (1)..(208): Utility: Useful for increasing chlorophyll and photosynthetic capacity
  misc_feature (1)..(208): Utility: Useful for making shorter plants and plants with modified flowers
  misc_feature (1)..(208): Utility: Useful for making smaller plants
MAFISQLYPDVYTQIVQPVGEVKQPKRRRKKTKGSVASADGGNGLFRKRKLTDEQVNMLEMSFGDEHKLESERKDRLAAELGLDPRQVAVWFQNRRARWKNKRLEEEYNKLKNSHDNVVVDKCRLESEVIQLKEQLYDAEREIQRLAERVEGGSSNSPISSSVSVEANETPFFGDYKVGDDGDDYDHLFYPVPENSYIDEAEWMSLYI

SEQ ID NO: 6734 - protein, 263 aa, Arabidopsis thaliana
  misc_feature (1)..(263): useful for making plants with modified plant phenotypes as described in USSN 12/139,269
  misc_feature (1)..(263): Public GI no. 7415614
  misc_feature (1)..(263): Utility: Useful for increasing chlorophyll and photosynthetic capacity
  misc_feature (1)..(263): Utility: Useful for making shorter plants and plants with modified flowers
  misc_feature (1)..(263): Utility: Useful for making smaller plants
MHVRNDSSGSSLVAMLASCSPAAAVQAQPGGGGMEDTVSCGQKRPYYSTIEASGEDPGEEDVGDDCIQQSKKRRLTFDQVRSHEKNFEIENKLEPERKMQLANELGLQPRQVAVWFQNRRARWKTKQLERDYEVLTLDYNRLKSEFEAVLQEKQELQDEMECLTEKIQTAIPNSADPILEKRKRIISMSQPSSLKTFEGPVKSERIAAEANGRNDALTPCKEEGSKEEGSKETSSDSISQVKYLTRTAFVLWIAARFSHCPIV

SEQ ID NO: 6735 - protein, 217 aa, Arabidopsis thaliana
  misc_feature (1)..(217): useful for making plants with modified plant phenotypes as described in USSN 12/139,269
  misc_feature (1)..(217): Public GI no. 4006894
  misc_feature (1)..(217): Utility: Useful for increasing chlorophyll and photosynthetic capacity
  misc_feature (1)..(217): Utility: Useful for making shorter plants and plants with modified flowers
  misc_feature (1)..(217): Utility: Useful for making smaller plants
MNYTVDDQNMAFISQLYPDVYTQIVQPVGEVKQPKRRRKKTKGSVASADGGNGLFRKRKLTDEQVNMLEMSFGDEHKLESERKDRLAAELGLDPRQVAVWFQNRRARWKNKRLEEEYNKLKNSHDNVVVDKCRLESEVIQLKEQLYDAEREIQRLAERVEGGSSNSPISSSVSVEANETPFFGDYKVGDDGDDYDHLFYPVPENSYIDEAEWMSLYI

SEQ ID NO: 6736 - DNA, 1640 bp, Arabidopsis thaliana
  misc_feature (1)..(1640): useful for making plants with modified plant phenotypes as described in USSN 12/139,269
  misc_feature (1)..(1640): Ceres CLONE ID no. 1011386
  misc_feature (1)..(1640): Also known as  Ceres CDNA ID no. 23648951
gattcattctcttcagtcagagatttcgaaaccctagtcgatttcgagatccaaccaactctgctccttatctcagcttgttgaatttgcgaagtatgggagacgctagagacaacgaagcctacgaggaggagctcttggactatgaagaagaagacgagaaggtcccagattctggaaacaaagttaacggtgaagccgtgaaaaaagggtacgtgggaatacacagttctggattcagagacttccttttaaaaccggagcttctcagagctattgttgactctggatttgaacatccatctgaagtgcaacatgaatgtatccctcaagctatcttgggcatggatgtcatctgccaagcaaagtctggtatggggaagactgctgtgtttgtcctgtctactctacaacagattgaaccatctcctggccaggtttctgcacttgtcttgtgccatacaagagagctagcttaccagatctgcaatgagtttgtgcgattcagtacctatctgcctgatacaaaggtttcggtgttctatggtggagtcaacattaaaattcacaaagacttgctgaagaatgaatgtcctcacattgttgttggtacccctggtcgggtgcttgcacttgccagggagaaagatctctctttgaagaatgtgaggcattttattcttgatgaatgtgataaaatgctcgagtcacttgacatgcgaagggatgtgcaggagattttcaagatgactcctcatgacaaacaagtaatgatgttctcagcaacgctcagcaaagagatacgcccagtctgcaaaaaatttatgcaagatccaatggaaatatatgtcgatgatgaagccaagttgactcttcatgggcttgtccagcactacatcaaactgagcgagatggagaaaaaccggaagttgaatgaccttcttgatgcgttggacttcaatcaagttgtcatttttgtgaagagcgtgagcagggctgctgagctgaacaagttactggtggaatgcaatttcccctcaatatgcatccactctggaatgtctcaagaagagaggttgactcgatacaaaagtttcaaggaagggcacaaaaggatccttgtggcgactgacttggtaggaagagggattgacattgagcgtgtcaacattgtcatcaactatgacatgccagattctgctgatacctatcttcacagggttggcagagctggtagatttggaaccaagggtcttgcaatcacatttgttgcatctgcttcagattcagaggttcttaaccaggtacaagagaggtttgaggttgatataaaggaacttccggagcagattgatacttcaacctacatgccttcttaaacaagtagcacgtccctcaggaaagaagctcttcagatttcaaccttgtaggtgttcgaagggtgatgggggttcacaactatctctcgctccgtttgttttagtgttttctatgacgacatttttttccatatgtttagaacgtctgttgtactctttaaaggagattcgagtcactctccaaatcgcacagttaaaagctgtccagttttttgtacaagagattattatgtttgaaatatcaggatttagtctcgactc

SEQ ID NO: 6737 - protein, 427 aa, Arabidopsis thaliana
  misc_feature (1)..(427): useful for making plants with modified plant phenotypes as described in USSN 12/139,269
  misc_feature (69)..(239): Pfam Name: DEAD; Pfam Description: DEAD/DEAH box helicase
  misc_feature (307)..(383): Pfam Name: Helicase_C; Pfam Description: Helicase conserved C-terminal domain
  misc_feature (69)..(239): Pfam Name: DEAD; Pfam Description: DEAD/DEAH box helicase
  misc_feature (307)..(383): Pfam Name: Helicase_C; Pfam Description: Helicase conserved C-terminal domain
  misc_feature (1)..(427): Utility: Useful for increasing chlorophyll and photosynthetic capacity
  misc_feature (1)..(427): Utility: Useful for making lethal plants for genetic confinement systems
  misc_feature (1)..(427): Utility: Useful for making plants sterile and for genetic confinement
  misc_feature (1)..(427): Utility: Useful for making smaller plants
  misc_feature (1)..(427): Utility: Useful for making taller plants and plants with longer inflorescences
MGDARDNEAYEEELLDYEEEDEKVPDSGNKVNGEAVKKGYVGIHSSGFRDFLLKPELLRAIVDSGFEHPSEVQHECIPQAILGMDVICQAKSGMGKTAVFVLSTLQQIEPSPGQVSALVLCHTRELAYQICNEFVRFSTYLPDTKVSVFYGGVNIKIHKDLLKNECPHIVVGTPGRVLALAREKDLSLKNVRHFILDECDKMLESLDMRRDVQEIFKMTPHDKQVMMFSATLSKEIRPVCKKFMQDPMEIYVDDEAKLTLHGLVQHYIKLSEMEKNRKLNDLLDALDFNQVVIFVKSVSRAAELNKLLVECNFPSICIHSGMSQEERLTRYKSFKEGHKRILVATDLVGRGIDIERVNIVINYDMPDSADTYLHRVGRAGRFGTKGLAITFVASASDSEVLNQVQERFEVDIKELPEQIDTSTYMPS

SEQ ID NO: 6738 - protein, 428 aa, Zea mays
  misc_feature (1)..(428): useful for making plants with modified plant phenotypes as described in USSN 12/139,269
  misc_feature (1)..(428): Ceres CLONE ID no. 1462142
  misc_feature (1)..(428): Utility: Useful for increasing chlorophyll and photosynthetic capacity
  misc_feature (1)..(428): Utility: Useful for making lethal plants for genetic confinement systems
  misc_feature (1)..(428): Utility: Useful for making plants sterile and for genetic confinement
  misc_feature (1)..(428): Utility: Useful for making smaller plants
  misc_feature (1)..(428): Utility: Useful for making taller plants and plants with longer inflorescences
MGEAKENDVYEEELLDYEEDDDKTVDGSAAKPTGEVAKKGYVGIHSSGFRDFLLKPELLRAIQDCGFEHPSEVQHECIPQAILGMDVICQAKSGMGKTAVFVLSSLQQIDPVAGQVAALVLCHTRELAYQICHEFERFSKYLTEVKVAVFYGGVHIRKHKDLLKNECPHIVVGTPGRILALARDKDLSLKNVRHFILDECDKMLESLDMRRDVQEIFKMTPHDKQVMMFSATLSKEIRPVCKKFMQDPMEIYVDDEAKLTLHGLVQHYIKLSEAEKNRKLNDLLDALDFNQVVIFVKSVSRAAELNKLLCECNFPSICIHSGMTQEERLTRYKNFKEGHKRILVATDLVGRGIDIERVNIVINYDMPDSADTYLHRVGRAGRFGTKGLAITFVSSASDSDVLNQVQERFEVDIKELPEQIDTSTYMPS

SEQ ID NO: 6739 - protein, 426 aa, Glycine max
  misc_feature (1)..(426): useful for making plants with modified plant phenotypes as described in USSN 12/139,269
  misc_feature (1)..(426): Ceres CLONE ID no. 476264
  misc_feature (1)..(426): Utility: Useful for increasing chlorophyll and photosynthetic capacity
  misc_feature (1)..(426): Utility: Useful for making lethal plants for genetic confinement systems
  misc_feature (1)..(426): Utility: Useful for making plants sterile and for genetic confinement
  misc_feature (1)..(426): Utility: Useful for making smaller plants
  misc_feature (1)..(426): Utility: Useful for making taller plants and plants with longer inflorescences
MGELKDTEAYEEELIDYEEEEEKAPDSAKPVAESGKKGYVGIHSSGFRDFLLKPELLRAIVDSGFEHPSEVQHECIPQAILGMDVICQAKSGMGKTAVFVLSTLQQVDPVPGQVAALVLCHTRELAYQICHEFERFSTYLPDIKAAVFYGGVNIKVHKELLKNECPHIVVGTPGRILALARDKDLGLKNVRHFILDECDKMLESLDMRRDVQEIFKLTPHDKQVMMFSATLSKEIRPVCKKFMQDPMEIYVDDEAKLTLHGLVQHYIKLQETEKNRKLNDLLDALDFNQVVIFVKSVSRAAELNKLLVECNFPSICIHSAMSQEERLKRYKGFKEGKQRILVATDLVGRGIDIERVNIVINYDMPDSADTYLHRVGRAGRFGTKGLAITFVSSTADSEVLNQVQSRFEVDIKELPEQIDTSTYMPN

SEQ ID NO: 6740 - DNA, 848 bp, Arabidopsis thaliana
  misc_feature (1)..(848): useful for making plants with modified plant phenotypes as described in USSN 12/139,269
  misc_feature (1)..(848): Ceres CLONE ID no. 6082
  misc_feature (1)..(848): Also known as  Ceres CDNA ID no. 23384719
acccctcttccctctctttatctctctcaagatttgctctgtccagagctccaaatttcaagaacataaacactacacacaaaacactgaatacgatgttgcttggaaagagacaacgaccaccgatcaacagaaccacaagtctatcggagataaagttcgatctaaaccttcccagcgagtcagagccatcaaatcaacagaagccaaccgttgcgagcccgtacggttccaacggtcaagctgtaacagcagccgttgatcaaaaccgtgggttcttagatcaacggctcttatccatggtcacaccgagaggtaacctgaggagacactcaggcgatttctccgacgctagacatttcttgagatcttgcgcactttgtgaacgccttcttgttcctggccgcgacatctatatgtataggggagataaggctttttgtagctcagagtgcaggcaagagcaaatggcacaagatgagaggaaagagaaaggtaaatcggcggcaccggcgaaagaaccggcggtgacagctcccgcgagagcgaaacccggcaaagggagagctgcagccgccgtgtaatccccattttcatatacattttagctatatatatgtgtggtttgctatgtgtttgtatatgattatgatgggtaatacatatataaagcattaagcgttaattaaccgtgattaactgtgttaatcaccctcgtgttgtggtgaaattagatgattttcgagggttaaattttacaagttttgatctatttgaaataaaatcaaatgtattatatatatgtaagacttgtgtttgttaagtacttaatgagaaaaattaagatt

SEQ ID NO: 6741 - protein, 162 aa, Arabidopsis thaliana
  misc_feature (1)..(162): useful for making plants with modified plant phenotypes as described in USSN 12/139,269
  misc_feature (74)..(132): Pfam Name: DUF581; Pfam Description: Protein of unknown function (DUF581)
  misc_feature (1)..(162): Utility: Useful for increasing increasing anthocyanin content
  misc_feature (1)..(162): Utility: Useful for making plants with altered leaf shape eg curled leaves
  misc_feature (1)..(162): Utility: Useful for making plants with increased biomass and foliage
  misc_feature (1)..(162): Utility: Useful for making smaller plants
MLLGKRQRPPINRTTSLSEIKFDLNLPSESEPSNQQKPTVASPYGSNGQAVTAAVDQNRGFLDQRLLSMVTPRGNLRRHSGDFSDAGHFLRSCALCERLLVPGRDIYMYRGDKAFCSSECRQEQMAQDERKEKGKSAAPAKEPAVTAPARAKPGKGRAAAAV

SEQ ID NO: 6742 - protein, 157 aa, Brassica napus
  misc_feature (1)..(157): useful for making plants with modified plant phenotypes as described in USSN 12/139,269
  misc_feature (1)..(157): Ceres CLONE ID no. 1068042
  misc_feature (1)..(157): Utility: Useful for increasing increasing anthocyanin content
  misc_feature (1)..(157): Utility: Useful for making plants with altered leaf shape eg curled leaves
  misc_feature (1)..(157): Utility: Useful for making plants with increased biomass and foliage
  misc_feature (1)..(157): Utility: Useful for making smaller plants
SPLSLFPRSLFRAKSRAHIHTLAMLLGKRQRPPINRTTSLSEIKFDLNLPSESEVPSTHQSPNQNTVVGPSGSNGQHVAAAVDPRFLAMVSPRGNLRRHSGEFSDAGHFLRSCSLCERLLVPGRDIYMYRGDTAFCSSECREQQMTQDEGKEKVKPT

SEQ ID NO: 6743 - protein, 143 aa, Glycine max
  misc_feature (1)..(143): useful for making plants with modified plant phenotypes as described in USSN 12/139,269
  misc_feature (1)..(143): Ceres CLONE ID no. 602291
  misc_feature (1)..(143): Utility: Useful for increasing increasing anthocyanin content
  misc_feature (1)..(143): Utility: Useful for making plants with altered leaf shape eg curled leaves
  misc_feature (1)..(143): Utility: Useful for making plants with increased biomass and foliage
  misc_feature (1)..(143): Utility: Useful for making smaller plants
  misc_feature (123)..(123): Xaa is any aa, unknown or other
  misc_feature (128)..(128): Xaa is any aa, unknown or other
  misc_feature (130)..(130): Xaa is any aa, unknown or other
  misc_feature (134)..(134): Xaa is any aa, unknown or other
  misc_feature (141)..(141): Xaa is any aa, unknown or other
MLLGKRPRPPMKRTTSMSEMTLDLNTAADAAAAADQQRSGVGPSAAADQTTRMLASPKILRRHSSYFGDARHFLRACSLCKRPLVPGRDIYMYRGDSAFCSLECRQQQINQDERKEKFVMASXKKVVXPXPFGXQVVATAXKG

SEQ ID NO: 6744 - protein, 199 aa, Glycine max
  misc_feature (1)..(199): useful for making plants with modified plant phenotypes as described in USSN 12/139,269
  misc_feature (1)..(199): Public GI no. 50945605
  misc_feature (1)..(199): Utility: Useful for increasing increasing anthocyanin content
  misc_feature (1)..(199): Utility: Useful for making plants with altered leaf shape eg curled leaves
  misc_feature (1)..(199): Utility: Useful for making plants with increased biomass and foliage
  misc_feature (1)..(199): Utility: Useful for making smaller plants
MMMMGKRGGRKNPMRRTTSMTEFAPPVDVLVGGRVADEAEAEAEADEATELEVSGGGEVEEEDAAVEEASYGWFGAGADGAGVRADWLAAYRARAAPALAGLRRNSADFSAVETAAFLRACGLCNRRLGPGRDTFMYKGDTAFCSLECRQQHITHEEWKEKRALAIATAAAAPPQPPPSMPDPTAAGSDNPAGGTLAAA

SEQ ID NO: 6745 - protein, 185 aa, Zea mays
  misc_feature (1)..(185): useful for making plants with modified plant phenotypes as described in USSN 12/139,269
  misc_feature (1)..(185): Ceres CLONE ID no. 347137
  misc_feature (1)..(185): Utility: Useful for increasing increasing anthocyanin content
  misc_feature (1)..(185): Utility: Useful for making plants with altered leaf shape eg curled leaves
  misc_feature (1)..(185): Utility: Useful for making plants with increased biomass and foliage
  misc_feature (1)..(185): Utility: Useful for making smaller plants
MMLGKRSGRPSPTARQHMRRTTSLTEFAAPDKVLADVAEEEDEELQLLPAHAEAAELEGPYGWAIGGAAAAGRADWLAAYRARAAPVLAGLRRNSADFSAAETAAFLRACGLCNRRLGPGRDTFVYRGDTAFCSLECRQQHITIEEWKEKCALATPPASDPVVPLPPRPSGAGSDKPATVLASKS

SEQ ID NO: 6746 - protein, 166 aa, Triticum aestivum
  misc_feature (1)..(166): useful for making plants with modified plant phenotypes as described in USSN 12/139,269
  misc_feature (1)..(166): Ceres CLONE ID no. 894286
  misc_feature (1)..(166): Utility: Useful for increasing increasing anthocyanin content
  misc_feature (1)..(166): Utility: Useful for making plants with altered leaf shape eg curled leaves
  misc_feature (1)..(166): Utility: Useful for making plants with increased biomass and foliage
  misc_feature (1)..(166): Utility: Useful for making smaller plants
MRRTTSLREVAPPSVLAVVLEDEDEDEQAKAVVQAEEGGAGGGQDWLAALGGGSGAPGTDWLAAYRARAAPARAGLRRNSADYSKVETAAFLRHCGLCRRLLGPGRDTFMYKGEAAFCSLECRQQHITHEEWKDKCTPRSMSEAAAPATSRGRSGKTDTGGTVAAA

SEQ ID NO: 6747 - DNA, 680 bp, Arabidopsis thaliana
  misc_feature (1)..(680): useful for making plants with modified plant phenotypes as described in USSN 12/139,269
  misc_feature (1)..(680): Ceres CLONE ID no. 13812
  misc_feature (1)..(680): Also known as  Ceres CDNA ID no. 23367346
aagaagatttgttcaggcacacgctaaaacacacaaacaaaaaaacaactcttcaagaacatatacatttaatatttatataaacaaaaaagaatggatcttgatttaatacaagatctgcccatcttgaatttcccaccagccatcaagatccgagccaacaccaacagagatgatgacggcggcggctgcaccactcccacttcttccgaccacaagattcctcccaccacagccaccactcctcctcctccaccgcagaaaccccgtccaccttccacaccgtcgtctctcggcatcagatcttgcaagagaaagcttatgacgtcattgtccaagtatgagatcatcgtcaacaaagatgagatcgagcggttcttctcctctgtttacaaccaaacgatggcgtcatccaccacgacggctatcacggtggccaagcggcgaagaagtttccgttcttgttcacgaagatgatcaataattggacgtttcattaaaggttccataatttcgaatagctttttcgatttttatttatttttatgtaatgtttttatcaactttacacgtcgacccactctataaatatacatgtgcgatcgatcgatggaatctttttttctttactaaaatttgctagctgttttgataacgaatgaccaaattccagtagtttc

SEQ ID NO: 6748 - protein, 127 aa, Arabidopsis thaliana
  misc_feature (1)..(127): useful for making plants with modified plant phenotypes as described in USSN 12/139,269
  misc_feature (1)..(127): Utility: Useful for increasing increasing anthocyanin content
  misc_feature (1)..(127): Utility: Useful for making ornamental plants with modified leaves
  misc_feature (1)..(127): Utility: Useful for making plants sterile and for genetic confinement
  misc_feature (1)..(127): Utility: Useful for making plants with increased biomass and foliage
  misc_feature (1)..(127): Utility: Useful for making smaller plants
MDLDLIQDLPILNFPPAIKIRANTNRDDDGGGCTTPTSSDHKIPPTTATTPPPPPQKPRPPSTPSSLGIRSCKRKLMTSLSKYEIIVNKDEIERFFSSVYNQTMASSTTTAITVAKRRRSFRSCSRR

SEQ ID NO: 6749 - protein, 122 aa, Brassica napus
  misc_feature (1)..(122): useful for making plants with modified plant phenotypes as described in USSN 12/139,269
  misc_feature (1)..(122): Ceres CLONE ID no. 1080126
  misc_feature (1)..(122): Utility: Useful for increasing increasing anthocyanin content
  misc_feature (1)..(122): Utility: Useful for making ornamental plants with modified leaves
  misc_feature (1)..(122): Utility: Useful for making plants sterile and for genetic confinement
  misc_feature (1)..(122): Utility: Useful for making plants with increased biomass and foliage
  misc_feature (1)..(122): Utility: Useful for making smaller plants
MDLDLLQDLPMLNFPSPIKIRSNNRDADGGGGGCTTPTSSDHKIPPSSATTPPPPPQKRRALPPSLVYRSCKRKLLTSSKFEIIANKDEIDRFFSSVYNQTMTSSPTTATTSTLPVARRRRS

SEQ ID NO: 6750 - protein, 133 aa, Brassica napus
  misc_feature (1)..(133): useful for making plants with modified plant phenotypes as described in USSN 12/139,269
  misc_feature (1)..(133): Ceres CLONE ID no. 873616
  misc_feature (1)..(133): Utility: Useful for increasing increasing anthocyanin content
  misc_feature (1)..(133): Utility: Useful for making ornamental plants with modified leaves
  misc_feature (1)..(133): Utility: Useful for making plants sterile and for genetic confinement
  misc_feature (1)..(133): Utility: Useful for making plants with increased biomass and foliage
  misc_feature (1)..(133): Utility: Useful for making smaller plants
  misc_feature (32)..(32): Xaa is any aa, unknown or other
MDIGLIQDLPMLNFPSPIKIRSNIDDDGNSGXCTTPTSSHHKIPPLTATTPPPPPQKRRPPPTPSSLVRSCKRKLMTSSKFEIIVNKDEIDRFFSSVYNQRVTSSPTTTTTTTTTTALTVSKRRRSFRSCSRK

SEQ ID NO: 6751 - protein, 129 aa, Glycine max
  misc_feature (1)..(129): useful for making plants with modified plant phenotypes as described in USSN 12/139,269
  misc_feature (1)..(129): Ceres CLONE ID no. 478304
  misc_feature (1)..(129): Utility: Useful for increasing increasing anthocyanin content
  misc_feature (1)..(129): Utility: Useful for making ornamental plants with modified leaves
  misc_feature (1)..(129): Utility: Useful for making plants sterile and for genetic confinement
  misc_feature (1)..(129): Utility: Useful for making plants with increased biomass and foliage
  misc_feature (1)..(129): Utility: Useful for making smaller plants
  misc_feature (25)..(25): Xaa is any aa, unknown or other
  misc_feature (79)..(79): Xaa is any aa, unknown or other
  misc_feature (103)..(103): Xaa is any aa, unknown or other
  misc_feature (125)..(125): Xaa is any aa, unknown or other
MSTDLHLHHELPKLRIAAVVKTDDXLPSDAQDDRNAVSSAVTQAEAENDGAITVDVGVKVNDESCRTPTSKESKIPATXTCPPAPRKPKFASCKRKLLEEFQXFDVTNKEDMDAFFRSTFPKRGXTTCT

SEQ ID NO: 6752 - DNA, 1103 bp, Arabidopsis thaliana
  misc_feature (1)..(1103): useful for making plants with modified plant phenotypes as described in USSN 12/139,269
  misc_feature (1)..(1103): Ceres CLONE ID no. 32811
  misc_feature (1)..(1103): Also known as  Ceres CDNA ID no. 23416861
tcacataatcacattgcatgattgatcaaatactcgattttccgtgaaatctctttgaatatttcgattccttgttaccatggcgcttcatgggtctggagttttttgtaaagtttcaaacatggtagagatcacttctccgtttggtggttccatgaggctgcttcacttgcctaaatcttatccgattcactgcaacatggtttcagctagcaatacatttgggtcagctcatctcaagctgcaaaacaaagaaccgtgctcccgtttaaggccttgtcgagtcaaacgcgaagaaaataaccaaactgcggatgttgaaagcatttcaatggatgagaacacgttgaagcaagatctcgagactgcggtccaggaagagaattatgtggaggcagctaaaatccgtgataaactaaaagagcttcaagaagacaacaaagcctctgttttatcagccaattctcggttctaccaatctttcagaaacggggatttagctgcgatgcaatcactatggtcaaaatcaggaaacccgtgctgtgtacatccaggggccaaaggcataactggttatgattacgtgatggaaagctgggagcttgtgtggatgaactatgagtttccgttactgattgagctgaaagatgtcgaggttcatgtccgaggagaagtaggttatgtaacgtgtatggagtttgtgaagacgaaagggagtagtagttggggagctcagtttgtgtcgaatgtgtttgaacggatcgatggacaatggtttatatgcattcaccatgcttctcctgttgatatttgatcaaagaatcgaagaaacgatacacattttcaaaacgttttatttttatatgcgtttggaggttgcggtgggatacattggtggtttgcttaagggtgatgaaggactgttttttatttctgaggttggcgattgggaatgaaaacgccacacaaacgagaagaggcataagttgtgacgtttgtactagaagaggcacaaaggatcattttattataaccagagccttgtagatctggcaaatcatgtagacaatgaaaaatgagaagaaaaataaactctttttatt

SEQ ID NO: 6753 - protein, 244 aa, Arabidopsis thaliana
  misc_feature (1)..(244): useful for making plants with modified plant phenotypes as described in USSN 12/139,269
  misc_feature (90)..(119): Pfam Name: UVR; Pfam Description: UvrB/uvrC motif
  misc_feature (90)..(119): Pfam Name: UVR; Pfam Description: UvrB/uvrC motif
  misc_feature (1)..(244): Utility: Useful for increasing increasing anthocyanin content
MALHGSGVFCKVSNMVEITSPFGGSMRLLHLPKSYPIHCNMVSASNTFGSAHLKLQNKEPCSRLRPCRVKREENNQTADVESISMDENTLKQDLETAVQEENYVEAAKIRDKLKELQEDNKASVLSANSRFYQSFRNGDLAAMQSLWSKSGNPCCVHPGAKGITGYDYVMESWELVWMNYEFPLLIELKDVEVHVRGEVGYVTCMEFVKTKGSSSWGAQFVSNVFERIDGQWFICIHHASPVDI

SEQ ID NO: 6754 - protein, 231 aa, Arabidopsis thaliana
  misc_feature (1)..(231): useful for making plants with modified plant phenotypes as described in USSN 12/139,269
  misc_feature (1)..(231): Public GI no. 50915438
  misc_feature (1)..(231): Utility: Useful for increasing increasing anthocyanin content
MAAAAASTPARAWWRAAAPASASTAAVSCFRVGAKSLTGLQMTSTRANKVRTVHVKSGEAEGSPSTESITRDEETLQRDLQTAIQEENYAQAAKLRDELRVLQEDSRSAVLAANARFYNAFKNGDLVAMHSAWAKGDHVYVVHPSAGRISGYDMVMQSWEMVCDADYEFPLQIDLQDVEVHVRGDLGYVTCLELVKTKGSSSWGRQVATNVFEKVDGKWFICIHHASHFDE

SEQ ID NO: 6755 - protein, 240 aa, Arabidopsis thaliana
  misc_feature (1)..(240): useful for making plants with modified plant phenotypes as described in USSN 12/139,269
  misc_feature (1)..(240): Public GI no. 51979387
  misc_feature (1)..(240): Utility: Useful for increasing increasing anthocyanin content
MAAPNPSATMAAAAASTPARAWWRAAAPASASTAAVSCFRVGAKSLTGLQMTSTRANKVRTVHVKSGEAEGSPSTESITRDEETLQRDLQTAIQEENYAQAAKLRDELRVLQEDSRSAVLAANARFYNAFKNGDLVAMHSAWAKGDHVYVVHPSAGRISGYDMVMQSWEMVCDADYEFPLQIDLQDVEVHVRGDLGYVTCLELVKTKGSSSWGRQVATNVFEKVDGKWFICIHHASHFDE

SEQ ID NO: 6756 - protein, 247 aa, Zea mays
  misc_feature (1)..(247): useful for making plants with modified plant phenotypes as described in USSN 12/139,269
  misc_feature (1)..(247): Ceres CLONE ID no. 322953
  misc_feature (1)..(247): Utility: Useful for increasing increasing anthocyanin content
MALAAATATTTSPARASWRPTVPATSASAAGVCFRVGAKRFSPGLRTASTCRHRHRGRTRLTTAHVKSGEAEGRPSTEESATGIGGPDEDSLRRELETAIEEEDYARAAALRDELRVLQEDCRAAVLAANARFYAAFKDGDLAAMRRAWARGDHVYVVHPSAGRISGYEMVMQSWEMVCDAGYEFPLQVDLQDVEVRVRGGVGYVTCLEMVRTKGSSSWGKQLATNVFEEVDGEWLMCVHHASHFDE

SEQ ID NO: 6757 - protein, 242 aa, Triticum aestivum
  misc_feature (1)..(242): useful for making plants with modified plant phenotypes as described in USSN 12/139,269
  misc_feature (1)..(242): Ceres CLONE ID no. 1004568
  misc_feature (1)..(242): Utility: Useful for increasing increasing anthocyanin content
MSAAQAASAILRPSASTPLREAAFFFTDNHNPSPARLCIRRGSAERTFAGLQIAASNFNRSRICHVKSGEADGYPQTEEDQLADEETLQRNLDRAIREEDYARAAKIRDDLRVLHEDTEASVLAANTRFYNAFKNGDFTAMYSIWAKGDHVYVVHPGAGRISGYDVVLQSWEMVCNADYEFPLNIDLKNIEVHVCGDLGYVTCLELVKTKGKSWGKQIATNVFEKIDGTWYICIHHASHIEE

SEQ ID NO: 6758 - DNA, 797 bp, Zea mays
  misc_feature (1)..(797): useful for making plants with modified plant phenotypes as described in USSN 12/139,269
  misc_feature (1)..(797): Ceres CLONE ID no. 224062
  misc_feature (1)..(797): Also known as  Ceres CDNA ID no. 23749815
cagaagggggcaaagctcgcggcctcgcgtcgcgccggtcgttccggtccaacgcggcgacgccaaaggctgccgtccccgggcttcctcctccccctcaccccttcccctcgccaaaccacaggaagaagcgagcagggcatcgagttttctcgatcgatggcatcggcgcctgccgattcctacgggtgcgcggcgtgcggcgcgcccctgaacctgtcggcggcgcacctgtacccggcggacttctacttcgaggccgggaacaagggcacgctgtccttctcgtgggtggacgagtcgcgcctgcggttcgcgcccgaggaccgcatccgccccttcttcgagaccctcaactactggggcatccagcggaagcgcacgcgcatcagctgcgacgcctgcggccacctgcttggccacgtctacgacgacggtccgccggccatgcagggcaccggccagttcgggatggggcccagccaggtcatcccgcgccgccccaggtaccgcttcaagatcaaggccatcgccgccagctcctcggcacctgccgccgccgcctatgaaaagtgatgctccatagatttcttcatctggttgcgtgtcctgtgtgctgtcggtgctgtggttcgtgacttcctgtaaattacgtagcttcctgcaattcgcgtcctgcgttgttttctttagaaacagtgtgtttgaaatggcatgcgactgaaactatgattgaaatggcatgcgacttctaatatacacacaagacagaagatataaataaaaaactatgattg

SEQ ID NO: 6759 - protein, 138 aa, Zea mays
  misc_feature (1)..(138): useful for making plants with modified plant phenotypes as described in USSN 12/139,269
  misc_feature (1)..(138): Utility: Useful for increasing increasing anthocyanin content
MASAPADSYGCAACGAPLNLSAAHLYPADFYFEAGNKGTLSFSWVDESRLRFAPEDRIRPFFETLNYWGIQRKRTRISCDACGHLLGHVYDDGPPAMQGTGQFGMGPSQVIPRRPRYRFKIKAIAASSSAPAAAAYEK

SEQ ID NO: 6760 - protein, 139 aa, Zea mays
  misc_feature (1)..(139): useful for making plants with modified plant phenotypes as described in USSN 12/139,269
  misc_feature (1)..(139): Ceres CLONE ID no. 1490254
  misc_feature (1)..(139): Utility: Useful for increasing increasing anthocyanin content
MASAPADSYGCAACGALLDLSAAHLYPADFYFEAGNKGTLSFSWVDESRLRFAPEDRIRPFFETLNYWGIQRKRTRISCDACGHLLGHVYDDGPPAMQGTGQFGMGPSQVIPRRPRYRFKIKAIAASSSAPAAAAAYGK

SEQ ID NO: 6761 - protein, 141 aa, Glycine max
  misc_feature (1)..(141): useful for making plants with modified plant phenotypes as described in USSN 12/139,269
  misc_feature (1)..(141): Ceres CLONE ID no. 1074247
  misc_feature (1)..(141): Utility: Useful for increasing increasing anthocyanin content
MAQPPAPATPAAAYGCAACGADLNLSASNLYPAGTYFEAGNKGTLSFSWVDESRLRFAAEDRIRPFFETLDYWGIQRKRTRVSCDACGRLLGHVYDDGPPLMDGTGQLGMGPSQVVPRRPRYRFKVKAVTAAGSSSAAAAR

SEQ ID NO: 6762 - protein, 135 aa, Glycine max
  misc_feature (1)..(135): useful for making plants with modified plant phenotypes as described in USSN 12/139,269
  misc_feature (1)..(135): Public GI no. 30680080
  misc_feature (1)..(135): Utility: Useful for increasing increasing anthocyanin content
MASTIYTCKECGSDLNLNPNDLFPPDFYFEAGNKGTLSFAAVDAEKFRFEKEDKIMPFFETLNYWGIQRKRTKIKCTSCNHLIGYIYDDGPPLTGGIGQYGFGPSQVIPRAPRYRFKTKARQDGWQYGGLTAFWN

SEQ ID NO: 6763 - protein, 127 aa, Arabidopsis thaliana
  misc_feature (1)..(127): useful for making plants with modified plant phenotypes as described in USSN 12/139,269
  misc_feature (1)..(127): Ceres CLONE ID no. 20269
  misc_feature (1)..(127): Utility: Useful for increasing increasing anthocyanin content
MASTIYTCKECGSDLNLNPNDLFPPDFYFEAGNKGTLSFAAVDAEKFRFEKEDKIMPFFETLNYWGIQRKRTKIKCTSCNHLIGYIYDDGPPLTGGIGQYGFGPSQVIPRAPRYRFKTKAVQVSSQT

SEQ ID NO: 6764 - protein, 127 aa, Arabidopsis thaliana; identical to SEQ ID NO: 6763
  misc_feature (1)..(127): useful for making plants with modified plant phenotypes as described in USSN 12/139,269
  misc_feature (1)..(127): Public GI no. 50058911
  misc_feature (1)..(127): Utility: Useful for increasing increasing anthocyanin content

SEQ ID NO: 6765 - protein, 127 aa, Brassica napus
  misc_feature (1)..(127): useful for making plants with modified plant phenotypes as described in USSN 12/139,269
  misc_feature (1)..(127): Ceres CLONE ID no. 1036315
  misc_feature (1)..(127): Utility: Useful for increasing increasing anthocyanin content
MAFTMYSCKECGSDLNLNPNDLFPPDFYFEAGNKATISFAAVDADKFRFEKEDKIMPFFETLNYWGIQRKRTKIKCHSCGHLVGYIYDDGPPLTGGIGQYGFGPSQVVPRAPRYRFKTKTLLISSQT

SEQ ID NO: 6766 - protein, 125 aa, Glycine max
  misc_feature (1)..(125): useful for making plants with modified plant phenotypes as described in USSN 12/139,269
  misc_feature (1)..(125): Ceres CLONE ID no. 592780
  misc_feature (1)..(125): Utility: Useful for increasing increasing anthocyanin content
MASVYSCTECGSNLNLNSAHAYPPDFYFEAGNKGSVSFSVADPTKFKFEKEDKLRPFFETVNYWGIQRKRTKIKCNTCDCLLGYVYDDGPPLTDSPGQFHMGPSQVIPRAPRYRFKTKTLRITST

SEQ ID NO: 6767 - DNA, 1209 bp, Arabidopsis thaliana
  misc_feature (1)..(1209): useful for making plants with modified plant phenotypes as described in USSN 12/139,269
  misc_feature (1)..(1209): Ceres CLONE ID no. 254065
  misc_feature (1)..(1209): Also known as  Ceres CDNA ID no. 23449358
aattagaatctttcccgacaaagaaatagctctaagcacgacctttttcttcctaagtcgccggcgagacaaaaaaaacataatcccgacggttacacgtaccggataattgtatttaagttgaatccgctttgtactttcctcacagccaaagatttttccttactaggattttcattttctcttctgttttcgtttcaaattcagaaaatcttccgtttcaatccggtttatatcggtttttagcaatgtcgatggtaactgtcaaagttagcaacgtttctcttgaagcaacagaaagagatctcaaggagttcttctctttttccggcgatattgcttacctcgagactcaaagcgagaatgatggttctaaattagcatatgtcacattcaaggatttacaaggagctgaaaccgcagttctcctcaccggatcgacgattgttgattcatcggtcacagttacaatgtcaccagattaccaactacctcctgatgctttagcttccattgaatcattgaaagagagcaataaatcatcatctcctacgcgagaagatgtatcggtatttagaaaagctgaagatgttgtaagtggtatgatttcaaaagggtttgttttaggtaaagacgctatagctaaagcgaagagtcttgatgagaagcatcagttgacatcaacagcttcagctagagttacatctttcgacaaaagaatcggattcacggagaaaatcaacaccgggactacagttgtgagcgaaaaagttaaagaagttgatcagaagtttcaagtcacagagaaaacaaaatcagcaatagctgctgctgagcagacagtgagcaatgctggttctgctataatgaaaaaccggtatgttttaaccggtgccacgtgggttacgggtgcgtttaacagagtgagtaaagctgctgaagaagttggacaaaaggcgaaagagaaagttggtttggctgaggaagaagaagaagagaagaagaaagtggttgatgaagttgctatagttcatctgactgaatcaccaaaggctttagaccaatcagaacaagattcaaaactccctgaatcaaaatcacagccacacaaggagcttaacgcaagtgttgtttgagctcaaccttgagatacgtataaggaactttctccaaacgttttttggaacaatgaagctgactctttaggac

SEQ ID NO: 6768 - protein, 295 aa, Arabidopsis thaliana
  misc_feature (1)..(295): useful for making plants with modified plant phenotypes as described in USSN 12/139,269
  misc_feature (6)..(73): Pfam Name: RRM_1; Pfam Description: RNA recognition motif. (a.k.a. RRM, RBD, or RNP domain)
  misc_feature (1)..(295): Utility: Useful for increasing increasing anthocyanin content
  misc_feature (1)..(295): Utility: Useful for making ornamental plants with modified leaves
  misc_feature (1)..(295): Utility: Useful for making smaller plants
MSMVTVKVSNVSLEATERDLKEFFSFSGDIAYLETQSENDGSKLAYVTFKDLQGAETAVLLTGSTIVDSSVTVTMSPDYQLPPDALASIESLKESNKSSSPTREDVSVFRKAEDVVSGMISKGFVLGKDAIAKAKSLDEKHQLTSTASARVTSFDKRIGFTEKINTGTTVVSEKVKEVDQKFQVTEKTKSAIAAAEQTVSNAGSAIMKNRYVLTGATWVTGAFNRVSKAAEEVGQKAKEKVGLAEEEEEEKKKVVDEVAIVHLTESPKALDQSEQDSKLPESKSQPHKELNASVV

SEQ ID NO: 6769 - protein, 313 aa, Arabidopsis thaliana
  misc_feature (1)..(313): useful for making plants with modified plant phenotypes as described in USSN 12/139,269
  misc_feature (1)..(313): Ceres CLONE ID no. 39922
  misc_feature (1)..(313): Utility: Useful for increasing increasing anthocyanin content
  misc_feature (1)..(313): Utility: Useful for making ornamental plants with modified leaves
  misc_feature (1)..(313): Utility: Useful for making smaller plants
MTMTTVKVSNVSLGATDRDLKEFFSFSGDILYLETQSETERTKLAYVTFKDLQGAETAVLLSGATIVDSSVIVSMAPDYQLSPEALASLEPKDSNKSPKAGDSVLRKAEDVVSSMLAKGFILGKDAIAKAKSVDEKHQLTSTASAKVASFDKKIGFTDKINTGTVVVGEKVREVDQKYQVSEKTKSAIAAAEQTVSNAGSAIMKNRYVLTGATWVTGAFNKVAKAAEEVGQKAKEKVGMAEEEDKRKVVDEFARVHLSESPKAASSTQEAERESKLSESPEAKKDSEHLEPQSKPLQQQSPPPMASAPAPAQP

SEQ ID NO: 6770 - protein, 313 aa, Arabidopsis thaliana; identical to SEQ ID NO: 6769
  misc_feature (1)..(313): useful for making plants with modified plant phenotypes as described in USSN 12/139,269
  misc_feature (1)..(313): Public GI no. 21593540
  misc_feature (1)..(313): Utility: Useful for increasing increasing anthocyanin content
  misc_feature (1)..(313): Utility: Useful for making ornamental plants with modified leaves
  misc_feature (1)..(313): Utility: Useful for making smaller plants

SEQ ID NO: 6771 - protein, 280 aa, Glycine max
  misc_feature (1)..(280): useful for making plants with modified plant phenotypes as described in USSN 12/139,269
  misc_feature (1)..(280): Ceres CLONE ID no. 477450
  misc_feature (1)..(280): Utility: Useful for increasing increasing anthocyanin content
  misc_feature (1)..(280): Utility: Useful for making ornamental plants with modified leaves
  misc_feature (1)..(280): Utility: Useful for making smaller plants
MTIKTVKVSNVSLGATEQDIKEFFSFSGDIEYVELQSHDERSQIAFITFKDSQGAETAVLLSGATIVDMPVTISLDPDYQLPPAALASPVRETRTPGGGADSAFRKAEDVVSGMLAKGFILGKDAVNKAKTFDEKHQLSSTASAKVASFDQKIGLSEKISAGATVVGDRVREVDQKFQVSEKTKSAFAAAEQTVSNAGSAIMKNRYVLTGASWVTGAFSKVSKAAGEVGQKTKEKVESAEEQQKRKVEDQYAQVLSESPKAAEASEQKSSKPAPAQGLIL

SEQ ID NO: 6772 - protein, 314 aa, Glycine max
  misc_feature (1)..(314): useful for making plants with modified plant phenotypes as described in USSN 12/139,269
  misc_feature (1)..(314): Public GI no. 32489377
  misc_feature (1)..(314): Utility: Useful for increasing increasing anthocyanin content
  misc_feature (1)..(314): Utility: Useful for making ornamental plants with modified leaves
  misc_feature (1)..(314): Utility: Useful for making smaller plants
MAASTFSTVKVSNVSLKASLRDVKEFFSFSGDIVHVEMQSSDELSQVAYITFKDNQGSETAMLLTGATIVDMAVIVTPATDYELPASVLAALEPKDSKPSALQKAEDIVGTMLAKGFILGRDALDRAKALDEKHQLTSTATARVSSFDKKMGLSEKISVGTSAVNDKVKEMDQKYQVSEKTRSALAAAEQSVSTAGSAIMKNRYVLTGAAWVTGAFNKVANAANDVGTKAKEKIASEQEHKTVELESAEPNSSEGHGTQKDVDGEFAKIQVSESPEDIPISTTATVPITDEDSSQASPPAASPKKPEPAQGLIL

SEQ ID NO: 6773 - protein, 303 aa, Zea mays
  misc_feature (1)..(303): useful for making plants with modified plant phenotypes as described in USSN 12/139,269
  misc_feature (1)..(303): Ceres CLONE ID no. 241340
  misc_feature (1)..(303): Utility: Useful for increasing increasing anthocyanin content
  misc_feature (1)..(303): Utility: Useful for making ornamental plants with modified leaves
  misc_feature (1)..(303): Utility: Useful for making smaller plants
  misc_feature (295)..(295): Xaa is any aa, unknown or other
MATSMLSTVKVSNVSLKAAQRDIKEFFSFSGDIVHVEMQSFDELSQVAYITFKDKQGAETAMLLTGATIVDMAVIVTPANDYELPSSVLAALEPKDTKPSALQKAEDIVGTMLAKGFILGRDALDKAKALDEKHQLTSTATARVSSFDKRIGLSEKISVGTSVVNDKVKEMDQKYQVSEKTKSALAAAEHSVSTAGSAIMKNRYVLTGAAWVTGAFSKVTSAANEAGAKAKEKIAVEQEHKNAEGGPAQANISETHEAHRGLDGGFSRLHDSETPEDIPISTASVPAVTDEEPSXGFSTSWCS

SEQ ID NO: 6774 - protein, 317 aa, Triticum aestivum
  misc_feature (1)..(317): useful for making plants with modified plant phenotypes as described in USSN 12/139,269
  misc_feature (1)..(317): Ceres CLONE ID no. 700178
  misc_feature (1)..(317): Utility: Useful for increasing increasing anthocyanin content
  misc_feature (1)..(317): Utility: Useful for making ornamental plants with modified leaves
  misc_feature (1)..(317): Utility: Useful for making smaller plants
MATSTLSTVMVSNLSLKAALRDVKEFFSFSGDLVHVEMQSGDELSQVAYIAFKDKQGAETAMLLTGATIVDMAVIVTPATDYELPADVLAALEPKDAKSSALEKAEDIVGTMLAKGFILGRDALDKAKALDEKHQLTSTATARVSSFDKRIGLSEKISVGTSVVNDKVKEMDQKYLVSEKTRSALAAAEQGVSTAGSAIMKNRYVLTGAAWVTGAFSKVANTANDVGAKAKEKIAAEQEGKTVAAGHAQADMSDAREKPRDLDGEVTKIHVSENPEDIPISTAAVFPITVDDSSDASPPPPATALPKKPEPAQGLIL

SEQ ID NO: 6775 - DNA, 1202 bp, Arabidopsis thaliana
  misc_feature (1)..(1202): useful for making plants with modified plant phenotypes as described in USSN 12/139,269
  misc_feature (1)..(1202): Ceres CLONE ID no. 22339
  misc_feature (1)..(1202): Also known as  Ceres CDNA ID no. 23368521
gttagatgatctgtccatttttttcttttttcttctgtgtataaatatatttgagcacaaagaaaaactaataaccttctgttttcagcaagtagggtcttataaccttcaaagaaatattccttcaattgaaaacccataaaccaaaatagatattacaaaaggaaagagagatattttcaagaacaacataattagaaaagcagaagcagcagttaagtggtactgagataaatgatatagtttctcttcaagaacagtttctcattacccaccttctcctttttgctgatctatcgtaatcttgagaactcaggatcaatggaggaaggtgggagtagtcacgacgcagagagtagcaagaaactagggagagggaaaatagagataaagaggatagagaacacaacaaatcgtcaagttactttctgcaaacgacgcaatggtcttctcaagaaagcttatgaactctctgtcttgtgtgatgccgaagttgccctcgtcatcttctccactcgtggccgtctctatgagtacgccaacaacagtgtgaggggtacaattgaaaggtacaagaaagcttgttccgatgccgtcaaccctccttccgtcaccgaagctaatactcagtactatcagcaagaagcctctaagcttcggaggcagattcgagatattcagaattcaaataggcatattgttggggaatcacttggttccttgaacttcaaggaactcaaaaacctagaaggacgtcttgaaaaaggaatcagccgtgtccgctccaaaaagaatgagctgttagtggcagagatagagtatatgcagaagagggaaatggagttgcaacacaataacatgtacctgcgagcaaagatagccgaaggcgccagattgaatccggaccagcaggaatcgagtgtgatacaagggacgacagtttacgaatccggtgtatcttctcatgaccagtcgcagcattataatcggaactatattccggtgaaccttcttgaaccgaatcagcaattctccggccaagaccaacctcctcttcaacttgtgtaactcaaaacatgataacttgtttcttcccctcataacgattaagagagagacgagagagttcattttatatttataacgcgactgtgtattcatagtttaggttctaataatgataataacaaaactgttgtttc

SEQ ID NO: 6776 - protein, 248 aa, Arabidopsis thaliana
  misc_feature (1)..(248): useful for making plants with modified plant phenotypes as described in USSN 12/139,269
  misc_feature (24)..(74): Pfam Name: SRF-TF; Pfam Description: SRF-type transcription factor (DNA-binding and dimerisation domain)
  misc_feature (89)..(188): Pfam Name: K-box; Pfam Description: K-box region
  misc_feature (1)..(248): Utility: Useful for increasing seed/fruit yield or modifying fruit content
  misc_feature (1)..(248): Utility: Useful for making plants with altered leaf shape eg curled leaves
MEEGGSSHDAESSKKLGRGKIEIKRIENTTNRQVTFCKRRNGLLKKAYELSVLCDAEVALVIFSTRGRLYEYANNSVRGTIERYKKACSDAVNPPSVTEANTQYYQQEASKLRRQIRDIQNSNRHIVGESLGSLNFKELKNLEGRLEKGISRVRSKKNELLVAEIEYMQKREMELQHNNMYLRAKIAEGARLNPDQQESSVIQGTTVYESGVSSHDQSQHYNRNYIPVNLLEPNQQFSGQDQPPLQLV

SEQ ID NO: 6777 - protein, 249 aa, Arabidopsis thaliana
  misc_feature (1)..(249): useful for making plants with modified plant phenotypes as described in USSN 12/139,269
  misc_feature (1)..(249): Public GI no. 17223670
  misc_feature (1)..(249): Utility: Useful for increasing seed/fruit yield or modifying fruit content
  misc_feature (1)..(249): Utility: Useful for making plants with altered leaf shape eg curled leaves
MDEGGSSHDAESSKKIGRGKIEIKRIENTTNRQVTFCKRRNGLLKKAYELSVLCDAEVALVIFSTRGLLYEYASNSVKGTIERYKKACSDAVNPPTVTEANTKHYQQEASKLRRQIRDIQNSNRHIVGESLGSLNFKELKNLEGRLEKGISRVRSKKSELLVAEIEYMQKREMELQHVNMYLRAKIEQGARLNPEQHGSGVIQGTAVYESGLSSSHDQSQHYNRNYIPVNLLEPNQQFSGQDQPPLQLV

SEQ ID NO: 6778 - protein, 246 aa, Arabidopsis thaliana
  misc_feature (1)..(246): useful for making plants with modified plant phenotypes as described in USSN 12/139,269
  misc_feature (1)..(246): Public GI no. 52548150
  misc_feature (1)..(246): Utility: Useful for increasing seed/fruit yield or modifying fruit content
  misc_feature (1)..(246): Utility: Useful for making plants with altered leaf shape eg curled leaves
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTVYESGVTSSHQSGQYNRNYIAVNLLEPNQNSSNQDQPPLQLV

SEQ ID NO: 6779 - protein, 246 aa, Arabidopsis thaliana
  misc_feature (1)..(246): useful for making plants with modified plant phenotypes as described in USSN 12/139,269
  misc_feature (1)..(246): Public GI no. 52548152
  misc_feature (1)..(246): Utility: Useful for increasing seed/fruit yield or modifying fruit content
  misc_feature (1)..(246): Utility: Useful for making plants with altered leaf shape eg curled leaves
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTAYESGVTSSHQSGQYNRNYIAVNLLEPNQNSSNQDQPPLQLV

SEQ ID NO: 6780 - protein, 246 aa, Arabidopsis thaliana
  misc_feature (1)..(246): useful for making plants with modified plant phenotypes as described in USSN 12/139,269
  misc_feature (1)..(246): Public GI no. 52548134
  misc_feature (1)..(246): Utility: Useful for increasing seed/fruit yield or modifying fruit content
  misc_feature (1)..(246): Utility: Useful for making plants with altered leaf shape eg curled leaves
MEDGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTVYESGVTSSHQSGQYNRNYIAVNLLEPNQNSSNQDQPPLQLV

SEQ ID NO: 6781 - protein, 249 aa, Arabidopsis thaliana
  misc_feature (1)..(249): useful for making plants with modified plant phenotypes as described in USSN 12/139,269
  misc_feature (1)..(249): Public GI no. 6970411
  misc_feature (1)..(249): Utility: Useful for increasing seed/fruit yield or modifying fruit content
  misc_feature (1)..(249): Utility: Useful for making plants with altered leaf shape eg curled leaves
MEFPKQITPADDPESSSQKKLGRGKIEIKRIENTTNRQVTFCKRRNGLLKKAYELSVLCDAEVALIVFSTRGRLYEYANNSVRATIERYKKACDSSNTGSVTETNVQFYQQEASKLRRQIREIQNSNRHILGEALSTLNVKELKNLEGRLEKGISRIRSKKNEMLFAEIEYMQKREIELQNHNNFLRAKIAENDRAQQQQANMMPGTLSAYDQSMPPPQSYDRSFLPVILESNHHYNRQGQNQTPLQLV

SEQ ID NO: 6782 - protein, 244 aa, Arabidopsis thaliana
  misc_feature (1)..(244): useful for making plants with modified plant phenotypes as described in USSN 12/139,269
  misc_feature (1)..(244): Public GI no. 5031217
  misc_feature (1)..(244): Utility: Useful for increasing seed/fruit yield or modifying fruit content
  misc_feature (1)..(244): Utility: Useful for making plants with altered leaf shape eg curled leaves
LATTEFPNQSSEGSSSQKKMGRGKIEIKRIENTTNRQVTFCKRRNGLLKKAYELSVLCDAEIALIVFSSRGRLYEYANNSVKSTIERYKKASDTSNPGSVSETNAQFYQQESSKLRRQIRDIQNLNRHIMGEALSSLTFRELKNLEGRLEKGISRIRSKKNELLFAEIEYMQKREIELQNANMYLRAKIAENERNQQQTELMPGSVYETMPSSQPYDRSFLVANLLEPPNHHYSRQDQTPLQLV

SEQ ID NO: 6783 - protein, 225 aa, Arabidopsis thaliana
  misc_feature (1)..(225): useful for making plants with modified plant phenotypes as described in USSN 12/139,269
  misc_feature (1)..(225): Public GI no. 14279306
  misc_feature (1)..(225): Utility: Useful for increasing seed/fruit yield or modifying fruit content
  misc_feature (1)..(225): Utility: Useful for making plants with altered leaf shape eg curled leaves
MGRGKIEIKRIENTTNRQVTFCKRRNGLLKKAYELSVLCDAEVALIVFSSRGRLYEYANNSVRTTIERYKKVCSDSSNTGSVSEANAQFYQQEASKLRRQIRDIQNLNRHILGEALSSLNFKELKNLETRLEKGISRIRSKKNELLFAEIEYMQKREIELQNSNLFLRAQIAENERAQQQMNLMPGSQYESVPQQPYDSQNLLPVNLLDPNHHYSRHDQTALQLV

SEQ ID NO: 6784 - protein, 241 aa, Arabidopsis thaliana
  misc_feature (1)..(241): useful for making plants with modified plant phenotypes as described in USSN 12/139,269
  misc_feature (1)..(241): Public GI no. 62132641
  misc_feature (1)..(241): Utility: Useful for increasing seed/fruit yield or modifying fruit content
  misc_feature (1)..(241): Utility: Useful for making plants with altered leaf shape eg curled leaves
MELPNEGGEGSSQKKLGRGKIEIKRIENTTNRQVTFCKRRNGLLKKAYELSVLCDAEVALVVFSTRGRLYEYANNSVRATIERYKKACAASTNAESVSEANTQFYQQESSKLRRQIRDIQNLNRHILGEALGSLSLKELKNLEGRLEKGLSRVRSRKHETLFADVEFMQKREIELQNHNNYLRAKIAEHERAQQQQQNLMPETMCESLPSQTYDRNFFPVNLLGSDQQEYSRQDQTALQLV

SEQ ID NO: 6785 - protein, 242 aa, Glycine max
  misc_feature (1)..(242): useful for making plants with modified plant phenotypes as described in USSN 12/139,269
  misc_feature (1)..(242): Ceres CLONE ID no. 1043518
  misc_feature (1)..(242): Utility: Useful for increasing seed/fruit yield or modifying fruit content
  misc_feature (1)..(242): Utility: Useful for making plants with altered leaf shape eg curled leaves
MEDPNQAQEGSSQKKMGRGKIEIKRIENTTNRQVTFCKRRNGLLKKAYELSVLCDAEVALVVFSTRGRLYEYANNSVRATIERYKKANAAASNAESVSEANTQFYQQESSKLRRQIRDIQNLNRHILGEALGSLSLKELKNLEGRLEKGLSRVRSRKHETLFADVEFMQKREIELQNHNNYLRAKIAEHERAQQQQSNMMSGTLCESLPSQSYDRNFFPVNLIASDDQQQYSSQDHTALQLV

SEQ ID NO: 6786 - protein, 243 aa, Glycine max
  misc_feature (1)..(243): useful for making plants with modified plant phenotypes as described in USSN 12/139,269
  misc_feature (1)..(243): Ceres CLONE ID no. 1046745
  misc_feature (1)..(243): Utility: Useful for increasing seed/fruit yield or modifying fruit content
  misc_feature (1)..(243): Utility: Useful for making plants with altered leaf shape eg curled leaves
  misc_feature (82)..(82): Xaa is any aa, unknown or other
  misc_feature (111)..(111): Xaa is any aa, unknown or other
MEDPNQAQEGSSQKKMGRGKIEIKRIENTTNRQVTFCKRRNGLLKKAYELSVLCDAEVALVVFSTRGRLYEYANNSVRATIXRYKKANAAASNAESVSEANTQFYQQESSXLRRQIRDIQNLNRHILGEALGSLSLKELKNLEGRLEKGLSRVRSRKHETLFADIEFMQKREIELQNHNNFLRAKIAENERAQQRQQDMIPGTECESTIPNSQSYDRNFFPVNLIDSNNNQYSRQDQTALQLV

SEQ ID NO: 6787 - protein, 242 aa, Glycine max
  misc_feature (1)..(242): useful for making plants with modified plant phenotypes as described in USSN 12/139,269
  misc_feature (1)..(242): Public GI no. 33308109
  misc_feature (1)..(242): Utility: Useful for increasing seed/fruit yield or modifying fruit content
  misc_feature (1)..(242): Utility: Useful for making plants with altered leaf shape eg curled leaves
MEFPNQAPESSSQKKLGRGKIEIKRIENTTNRQVTFCKRRNGLLKKAYELSVLCDAEVALIVFSNRGRLYEYANNSVRATIDRYKKAYADPTNSGSVSEANTQFYQQEASKLRRQIREIQNSNRHILGEALSSLNAKELKNLEGRLEKGISRIRSKKNEMLFSEIEFMQKRETELQHHNNFLRAKIAENEREEQQHTHMMPGTSYDQSMPSHSYDRNFLPAVILESNNNHYPHQVQTALQLV

SEQ ID NO: 6788 - protein, 242 aa, Glycine max
  misc_feature (1)..(242): useful for making plants with modified plant phenotypes as described in USSN 12/139,269
  misc_feature (1)..(242): Public GI no. 16973296
  misc_feature (1)..(242): Utility: Useful for increasing seed/fruit yield or modifying fruit content
  misc_feature (1)..(242): Utility: Useful for making plants with altered leaf shape eg curled leaves
MEFANQAPESSTQKKLGRGKIEIKRIENTTNRQVTFCKRRNGLLKKAYELSVLCDAEVALIVFSTRGRLYEYANNSVRATIDRYKKACADSTDGGSVSEANTQFYQQEASKLRRQIREIQNSNRHILGESLSTLKVKELKNLEGRLEKGISRIRSKKNEILFSEIEFMQKRETELQHHNNFLRAKIAESEREQQQQQTHMIPGTSYDPSMPSNSYDRNFFPVILESNNNHYPRQGQTALQLV

SEQ ID NO: 6789 - DNA, 1371 bp, Arabidopsis thaliana
  misc_feature (1)..(1371): useful for making plants with modified plant phenotypes as described in USSN 12/139,269
  misc_feature (1)..(1371): Ceres CLONE ID no. 99784
  misc_feature (1)..(1371): Also known as  Ceres CDNA ID no. 23363679
ataaaatggcgcaaagtgtgaaagttgaaacatatcctcatatttagcatcactcctctaatattattttttcaaacaagaacaatggcaaaccatctccaagtccccttaaccaaaccggatcgagttaaagaagaacaagaggttgaagaagaggcaagattgctagcgagaaggctcgcgaatgcagccgcattacctatggttctcaaagccgccttggagctcggcgtgatcgacaccatcaccacagtaggaggtggcgatttgtggctctcaccttctgaaatagcactaagactcccaaccaaaccatgcaacctggaagctccggttttgctagaccgtatgcttcgatttctcgtcagccattcggtcttaaaatgccgtactgtaatagaagagaacggtcaaaccggaaaagttgagagggtatatgcagctgaaccggtctgcaaatatctcttgaacaaaagtgacgacgtctcgggttcttttgcatcgctctttatgcttgacctcagcgacgtatttatcaagacatggacacatctcaaagatgtgatattagcaggaagagatgcatttagttctgcccatgggatgaaactattcgaatacatccaagccgatgagcgatttggtaaagtgtttaaccgggctatgttggaatcttccaccatggttacggagaaggttcttaaattttatgaaggattcaaagatgtgaagactttggtggatgtagggggaggacttggcaacacactaggtctcatcacttccaagtatcctcatcttattggtatcaatttcgatttagctccggtgttagccaatgctcattcttatcccggtgtgaaccatgtggctggtgatatgttcatcaagattccaaagggggatgccattttcatgaagtggatactacatgattggacggacgaacaatgcgtagcaattcttaaaaactgttggaaaagtctcgaagaaaatggaaaactgataatagtggaaatggttacaccggtggaagcaaagagcggagatatatgttctaacattgtgtttggtatggacatgacaatgttaacacaatgttcaggtggtaaagagagatctctctatgagtttgaaaatttagcatatgcatcgggtttttctcgttgtgcaatcgtatgcgctgtttatccattttccgtcatcgaaatctacaaatagattcattcaacatatgccattttacgatatttacacaacccgtttcttcttctatttgggatgtaatgtttgtgattatcatttgtgtgtggtcgatcttttgtaatgttttcgtgtgatgttcttaccgttgtaatgatatatgtgtct

SEQ ID NO: 6790 - protein, 378 aa, Arabidopsis thaliana
  misc_feature (1)..(378): useful for making plants with modified plant phenotypes as described in USSN 12/139,269
  misc_feature (40)..(99): Pfam Name: Dimerisation; Pfam Description: Dimerisation domain
  misc_feature (107)..(355): Pfam Name: Methyltransf_2; Pfam Description: O-methyltransferase
  misc_feature (1)..(378): Utility: Useful for increasing seed/fruit yield or modifying fruit content
  misc_feature (1)..(378): Utility: Useful for making plants sterile and for genetic confinement
  misc_feature (1)..(378): Utility: Useful for making smaller plants
  misc_feature (1)..(378): Utility: Useful for making taller plants and plants with longer inflorescences
  misc_feature (328)..(328): Xaa is any aa, unknown or other
MANHLQVPLTKPDRVKEEQEVEEEARLLARRLANAAALPMVLKAALELGVIDTITTVGGGDLWLSPSEIALRLPTKPCNLEAPVLLDRMLRFLVSHSVLKCRTVIEENGQTGKVERVYAAEPVCKYLLNKSDDVSGSFASLFMLDLSDVFIKTWTHLKDVILAGRDAFSSAHGMKLFEYIQADERFGKVFNRAMLESSTMVTEKVLKFYEGFKDVKTLVDVGGGLGNTLGLITSKYPHLIGINFDLAPVLANAHSYPGVNHVAGDMFIKIPKGDAIFMKWILHDWTDEQCVAILKNCWKSLEENGKLIIVEMVTPVEAKSGDICSNIXFGMDMTMLTQCSGGKERSLYEFENLAYASGFSRCAIVCAVYPFSVIEIYK

SEQ ID NO: 6791 - protein, 378 aa, Arabidopsis thaliana
  misc_feature (1)..(378): useful for making plants with modified plant phenotypes as described in USSN 12/139,269
  misc_feature (1)..(378): Public GI no. 9759075
  misc_feature (1)..(378): Utility: Useful for increasing seed/fruit yield or modifying fruit content
  misc_feature (1)..(378): Utility: Useful for making plants sterile and for genetic confinement
  misc_feature (1)..(378): Utility: Useful for making smaller plants
  misc_feature (1)..(378): Utility: Useful for making taller plants and plants with longer inflorescences
MANHLQVPLTKPDRVKEEQEVEEEARLLARRLANAAASPMVLKAALELGVIDTITTVGGGDLWLSPSEIALRLPTKPCNLEAPALLDRMLRFLVSHSVLKCRTVIEENGQTGKVERVYAAEPVCKYLLNKSDDVSGSFASLFMLDLSDVFIKTWTHLEDVILEGRDAFSSAHGMKLFEYIQADERFGKVFNRAMLESSTMVTEKVLKFYEGFKDVKTLVDVGGGLGNTLGLITSKYPHLIGINFDLAPVLANAHSYPGVNHVAGDMFIKIPKGDAIFMKWILHDWTDEQCVAILKNCWKSLEENGKLIIVEMVTPVEAKSGDICSNIVFGMDMTMLTQCSGGKERDLYEFENLAYASGFSRCAIVCAVYPFSVIEIYK

SEQ ID NO: 6792 - protein, 381 aa, Arabidopsis thaliana
  misc_feature (1)..(381): useful for making plants with modified plant phenotypes as described in USSN 12/139,269
  misc_feature (1)..(381): Public GI no. 12323398
  misc_feature (1)..(381): Utility: Useful for increasing seed/fruit yield or modifying fruit content
  misc_feature (1)..(381): Utility: Useful for making plants sterile and for genetic confinement
  misc_feature (1)..(381): Utility: Useful for making smaller plants
  misc_feature (1)..(381): Utility: Useful for making taller plants and plants with longer inflorescences
MSNHLQDPLTTYPKPGLTKEEQEIDEKMVSLQAESIVNAVAFPMVLKAALELGVIDTIAAASNGTWLSPSEIAVSLPNKPTNPEAPVLLDRMLRLLVSHSILKCCMVESRENGQTGKIERVYAAEPICKYFLKDSDGSGSLSSLLLLLHSQVILKTWTNLKDVILEGKDAFSSAHDMRLFEYISSDDQFSKLFHRAMSESSTMVMKKVLEEYRGFEDVNTLVDVGGGIGTILGLITSKYPHIKGVNFDLAQVLTQAPFYPGVKHVSGDMFIEVPKGDAIFMKWILHDWGDEDCIKILKNCWKSLPEKGKVIIVEMITPMEPKPNDFSCNTVLGMDLLMLTQCSGGKERSLSQFENLAFASGFLLCEIICLSYSYSVIEFHK

SEQ ID NO: 6793 - protein, 381 aa, Arabidopsis thaliana
  misc_feature (1)..(381): useful for making plants with modified plant phenotypes as described in USSN 12/139,269
  misc_feature (1)..(381): Public GI no. 27808586
  misc_feature (1)..(381): Utility: Useful for increasing seed/fruit yield or modifying fruit content
  misc_feature (1)..(381): Utility: Useful for making plants sterile and for genetic confinement
  misc_feature (1)..(381): Utility: Useful for making smaller plants
  misc_feature (1)..(381): Utility: Useful for making taller plants and plants with longer inflorescences
MTNHLQDPLPTYPKPVLTKEEQEVDEKMVSLQAESIVNTVAFPMVLKAAFELGVIDTIAAAGNDTWLSPCEIACSLPTKPTNPEAPVLLDRMLSLLVSHSILKCRMIETGENGRTGKIERVYAAEPVCKYFLSDSDGTGSLVPLFMLLHTQVFFKTWTNLKDVILEGRDAFNSAHGMKIFEYINSDQPFAELFNRAMSEPSTMIMKKVLDVYRGFEDVNTLVDVGGGNGTVLGLVTSKYPHIKGVNFDLAQVLTQAPFYPGVEHVSGDMFVEVPKGDAVFMKWILHDWGDEDCIKILKNCWKSLPEKGKIIIVEFVTPKEPKGGDLSSNTVFAMDLLMLTQCSGGKERSLSQFENLAFASGFLRCEIICLAYSYSVIEFHK

SEQ ID NO: 6794 - protein, 381 aa, Arabidopsis thaliana
  misc_feature (1)..(381): useful for making plants with modified plant phenotypes as described in USSN 12/139,269
  misc_feature (1)..(381): Public GI no. 12323395
  misc_feature (1)..(381): Utility: Useful for increasing seed/fruit yield or modifying fruit content
  misc_feature (1)..(381): Utility: Useful for making plants sterile and for genetic confinement
  misc_feature (1)..(381): Utility: Useful for making smaller plants
  misc_feature (1)..(381): Utility: Useful for making taller plants and plants with longer inflorescences
MTNHLQDPLPTYPKPVLTKEEQEVDEKMVSLQAESIVNTVAFPMVLKAAFELGVIDTIAAAGNDTWLSPCEIACSLPTKPTNPEAPVLLDRMLSLLVSHSILKCRMIETGENGRTGKIERVYAAEPVCKYFLRDSDGTGSLVPLFMLLHTQVFFKTWTNLKDVILEGRDAFNSAHGMKIFEYINSDQPFAELFNRAMSEPSTMIMKKVLDVYRGFEDVNTLVDVGGGNGTVLGLVTSKYPHIKGVNFDLAQVLTQAPFYPGVEHVSGDMFVEVPKGDAVFMKWILHDWGDEDCIKILKNCWKSLPEKGKIIIVEFVTPKEPKGGDLSSNTVFAMDLLMLTQCSGGKERSLSQFENLAFASGFLRCEIICLAYSYSVIEFHK

SEQ ID NO: 6795 - protein, 371 aa, Arabidopsis thaliana; identical to SEQ ID NO: 5937
  misc_feature (1)..(371): useful for making plants with modified plant phenotypes as described in USSN 12/139,269
  misc_feature (1)..(371): Public GI no. 47232556
  misc_feature (1)..(371): Utility: Useful for increasing seed/fruit yield or modifying fruit content
  misc_feature (1)..(371): Utility: Useful for making plants sterile and for genetic confinement
  misc_feature (1)..(371): Utility: Useful for making smaller plants
  misc_feature (1)..(371): Utility: Useful for making taller plants and plants with longer inflorescences

SEQ ID NO: 6796 - protein, 365 aa, Arabidopsis thaliana
  misc_feature (1)..(365): useful for making plants with modified plant phenotypes as described in USSN 12/139,269
  misc_feature (1)..(365): Public GI no. 6760443
  misc_feature (1)..(365): Utility: Useful for increasing seed/fruit yield or modifying fruit content
  misc_feature (1)..(365): Utility: Useful for making plants sterile and for genetic confinement
  misc_feature (1)..(365): Utility: Useful for making smaller plants
  misc_feature (1)..(365): Utility: Useful for making taller plants and plants with longer inflorescences
MGSTGETQMTPTHVSDEEANLFAMQLASASVLPMVLKAAIELDLLEIMAKAGPGSFLSPSDLASQLPTKNPEAPVMLDRMLRLLASYSILTCSLRTLPDGKVERLYCLGPVCKFLTKNEDGVSIAALCLMNQDKVLVESWYHLKDAVLDGGIPFNKAYGMTAFDYHGTDPRFNKVFNKGMADHSTITMKKILETYKGFEGLKSIVDVGGGTGAVVNMIVSKYPSIKGINFDLPHVIEDAPQYPGVQHVGGDMFVSVPKGNAIFMKWICHDWSDEHCIKFLKNCYAALPDDGKVILAECILPVAPDTSLATKGVVHMDVIMLAHNPGGKERTEQEFEALAKGSGFQGIRVCCDAFNTYVIEFLKKI

SEQ ID NO: 6797 - protein, 363 aa, Arabidopsis thaliana
  misc_feature (1)..(363): useful for making plants with modified plant phenotypes as described in USSN 12/139,269
  misc_feature (1)..(363): Public GI no. 18025321
  misc_feature (1)..(363): Utility: Useful for increasing seed/fruit yield or modifying fruit content
  misc_feature (1)..(363): Utility: Useful for making plants sterile and for genetic confinement
  misc_feature (1)..(363): Utility: Useful for making smaller plants
  misc_feature (1)..(363): Utility: Useful for making taller plants and plants with longer inflorescences
MGSANPDNKNSMTKEEEEACLSAMRLASASVLPMVLKSAIELDLLELIKKSGPGAYVSPSELAAQLPTQNPDAPVMLDRILRLLASYSVLNCTLKDLPDGGIERLYSLAPVCKFLTKNEDGVSMAALLLMNQDKVLMESWYHLKDAVLEGGIPFNKAYGMTAFEYHGKDPRFNKVFNQGMSNHSTIIMKKILEIYQGFQGLKTVVDVGGGTGATLNMIVSKYPSIKGINFDLPHVIEDAPSYPGVDHVGGDMFVSVPKGDAIFMKWICHDWSDAHCLKFLKNCHEALPENGKVILAECLLPEAPDSTLSTQNTVHVDVIMLAHNPGGKERTEKEFEALAKGAGFRGFIKVCCAYNSWIMELLK

SEQ ID NO: 6798 - protein, 283 aa, Zea mays
  misc_feature (1)..(283): useful for making plants with modified plant phenotypes as described in USSN 12/139,269
  misc_feature (1)..(283): Ceres CLONE ID no. 283499
  misc_feature (1)..(283): Utility: Useful for increasing seed/fruit yield or modifying fruit content
  misc_feature (1)..(283): Utility: Useful for making plants sterile and for genetic confinement
  misc_feature (1)..(283): Utility: Useful for making smaller plants
  misc_feature (1)..(283): Utility: Useful for making taller plants and plants with longer inflorescences
  misc_feature (7)..(7): Xaa is any aa, unknown or other
MLRLLAXYDVVRCQMEDRDGRYERRYSAAPVCKWLTPNEDGVSMAALALMNQDKVLMESWYYLKDAVLDGGIPFNKAYGMTAFEYHGTDARFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWAIEFIK

SEQ ID NO: 6799 - protein, 362 aa, Zea mays; identical to SEQ ID NO: 5943
  misc_feature (1)..(362): useful for making plants with modified plant phenotypes as described in USSN 12/139,269
  misc_feature (1)..(362): Public GI no. 4808524
  misc_feature (1)..(362): Utility: Useful for increasing seed/fruit yield or modifying fruit content
  misc_feature (1)..(362): Utility: Useful for making plants sterile and for genetic confinement
  misc_feature (1)..(362): Utility: Useful for making smaller plants
  misc_feature (1)..(362): Utility: Useful for making taller plants and plants with longer inflorescences

SEQ ID NO: 6800 - protein, 365 aa, Zea mays
  misc_feature (1)..(365): useful for making plants with modified plant phenotypes as described in USSN 12/139,269
  misc_feature (1)..(365): Public GI no. 602588
  misc_feature (1)..(365): Utility: Useful for increasing seed/fruit yield or modifying fruit content
  misc_feature (1)..(365): Utility: Useful for making plants sterile and for genetic confinement
  misc_feature (1)..(365): Utility: Useful for making smaller plants
  misc_feature (1)..(365): Utility: Useful for making taller plants and plants with longer inflorescences
MGSTGETQMTPTQVSDEEANLFAMQLASASVLPMVLKAAIELDLLEIMAKAGPGVFLSPTDIASQLPTKNPDAPVMLDRMLRLLASYSILTYSLRTLADGKVERLYGLGPVCKFLTKNEEGVSIAPLCLMNQDKVLLESWYHLKDAVLEGGIPFNKAYGMTAFEYHGTDPRFNKVFNRGMADHSTITMKKILETYKGFEGLTSVVDVGGGTGAVLNMIVSKYPSIKGINFDLPHVIEDAPQYPGVEHVGGDMFVSVPKGDAIFMKWICHDWSDEHCLKFLKNCYAALPDNGKVILGECILPVAPDSSLATKGVVHIDVIMLAHNPGGKERTEQEFQALAKGAGFQGFNVACSAFNTYVIEFLKKN

SEQ ID NO: 6801 - protein, 360 aa, Glycine max; identical to SEQ ID NO: 5942
  misc_feature (1)..(360): useful for making plants with modified plant phenotypes as described in USSN 12/139,269
  misc_feature (1)..(360): Ceres CLONE ID no. 561287
  misc_feature (1)..(360): Utility: Useful for increasing seed/fruit yield or modifying fruit content
  misc_feature (1)..(360): Utility: Useful for making plants sterile and for genetic confinement
  misc_feature (1)..(360): Utility: Useful for making smaller plants
  misc_feature (1)..(360): Utility: Useful for making taller plants and plants with longer inflorescences

SEQ ID NO: 6802 - protein, 353 aa, Triticum aestivum
  misc_feature (1)..(353): useful for making plants with modified plant phenotypes as described in USSN 12/139,269
  misc_feature (1)..(353): Ceres CLONE ID no. 751041
  misc_feature (1)..(353): Utility: Useful for increasing seed/fruit yield or modifying fruit content
  misc_feature (1)..(353): Utility: Useful for making plants sterile and for genetic confinement
  misc_feature (1)..(353): Utility: Useful for making smaller plants
  misc_feature (1)..(353): Utility: Useful for making taller plants and plants with longer inflorescences
MAASADEEACMYALQLVSSSILPMTLKNAIELGLLETLVAAGGKLLTPAEVAAKLPSTANPAAADMVDRMLRLLASYNVVSCTMEEGKDGRLSRRYRAAPVCKFLTPNEDGVSMAALALMNQDKVLMESWYYLKDAVLDGGIPFNKAYGMSAFEYHGTDPRFNRVFNEGMKNHSIIITKKLLEVYKGFEGLGTIVDVGGGVGATVGAITAAYPAIKGINFDLPHVISEAQPFPGVTHVGGDMFQKVPSGDAILMKWILHDWSDEHCATLLKNCYDALPAHGKVVLVECILPVNPEATPKAQGVFHVDMIMLAHNPGGRERYEREFEALAKGAGFKAIKTTYIYANAFAIEFTK

SEQ ID NO: 6803 - protein, 364 aa, Zea mays
  misc_feature (1)..(364): useful for making plants with modified plant phenotypes as described in USSN 12/139,269
  misc_feature (1)..(364): Ceres CLONE ID no. 286311
  misc_feature (1)..(364): Utility: Useful for increasing seed/fruit yield or modifying fruit content
  misc_feature (1)..(364): Utility: Useful for making plants sterile and for genetic confinement
  misc_feature (1)..(364): Utility: Useful for making smaller plants
  misc_feature (1)..(364): Utility: Useful for making taller plants and plants with longer inflorescences
MGSTAGDVAAVVDEEACMYAMQLASSSILPMTLKNAIELGLLEVLQKEAGGGKAALAPEEVVARMPAAPGDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDSRFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATCIYANAWAIEFIK

SEQ ID NO: 6804 - protein, 285 aa, Triticum aestivum
  misc_feature (1)..(285): useful for making plants with modified plant phenotypes as described in USSN 12/139,269
  misc_feature (1)..(285): Ceres CLONE ID no. 570057
  misc_feature (1)..(285): Utility: Useful for increasing seed/fruit yield or modifying fruit content
  misc_feature (1)..(285): Utility: Useful for making plants sterile and for genetic confinement
  misc_feature (1)..(285): Utility: Useful for making smaller plants
  misc_feature (1)..(285): Utility: Useful for making taller plants and plants with longer inflorescences
  misc_feature (127)..(127): Xaa is any aa, unknown or other
  misc_feature (130)..(130): Xaa is any aa, unknown or other
  misc_feature (133)..(133): Xaa is any aa, unknown or other
  misc_feature (134)..(134): Xaa is any aa, unknown or other
  misc_feature (136)..(136): Xaa is any aa, unknown or other
  misc_feature (139)..(139): Xaa is any aa, unknown or other
MLRLLASYNVVSCTMEEGKDGRLSRRYGAAPVCKFLTPNEDGVSMAALALMNQDKVLMESWYYLKDAVLDGGIPFNKAYGMSAFEYHGTDPRFNRVFNEGMKNHSIIITKKLLEVYKGFEGLGTIVXVGXKVXXAXVGXIVAAYPAIKGINFDLPHVISEAPPFPGVTHVGGDMFQKVPSGDAILMKWILHDWSDEHCATLLKNCYDALPAHGKVVLVECILPVNPEATPKAQGVFHVDMIMLAHNPGGRERYEREFEALAKGAGFKAIKTTYIYANAFAIEFTK

SEQ ID NO: 6805 - DNA, 1208 bp, Arabidopsis thaliana
  misc_feature (1)..(1208): useful for making plants with modified plant phenotypes as described in USSN 12/139,269
  misc_feature (1)..(1208): Ceres CLONE ID no. 100319
  misc_feature (1)..(1208): Also known as  Ceres CDNA ID no. 23389186
  misc_feature (1023)..(1023): k is g or t/u
  misc_feature (1032)..(1032): y is t/u or c
  misc_feature (1044)..(1044): r is g or a
aaaaatcgaatcaagcatcttcttctttcacgtacgaaacaaaaagctcagagcagagtcgaatcgcgatgaagcatcgagttcggtgttcatgaaggtcagagagttaagtattagcagaactggttaggtcttagtgacaaacaaggtattcatgttatccatccctgatactagaatgtggaatctagcatcgagttatcttacgggaaacattggaccgaaaaacgatatcagaagaccggtccatgctcatgcggagtgttcagatgacgatgtatcttctgtaggtagtaaagacgaaggtctcgagtgtcctatatgctgggaatcatttaatatagttgaaaacgttccgtatgtgttatggtgtggacatacgatgtgtaaaaactgcattttgggacttcaatgggctattgtgaaattgcctactcacccggttcagcttcctctcttcatttcatgcccctggtgcaaccttttgtctttccgtctggtcttcagaggaacactcagattccctcacaagaactactttgtgctttggatggtcgagaggatgaatggagagagacgtaactcacctggtggagctcaaacagatggaaacaatgatcatacaagggaaactccatctccatgtctccacaatcgccatcatcgcagtcaacctgaaccatcacgttctgttaatgatcatcgcattccaagggacaacatacaaacttcactgaggaagtctctggttttctttgtccagttgacagcaaagttcccattagttgtcatatttctgctgataatactctatgcaataccgaccagtgcagccatattggcgatgtacattctagtcactctcttgctggctctaccgtcgtttctcatcctctacttcgcttatccttgtctcgactggcttgttcgagagattgtcacatgaactttctaaggatgcgttcagaaacttcccattcctaatttgacgacttttcttcaacaactgagacccaagatcgktcagtcctycatgtaagtatracaatttcataattaccgtcttctttatctatatatggatgtagttttggattgcattgttgctctacgaagctggacgtatgtgttgtaagggctcttgcagaaacttattagtatttgtggatttgtttgtgagtgtttgagtgtctcaataagatttatgt

SEQ ID NO: 6806 - protein, 263 aa, Arabidopsis thaliana
  misc_feature (1)..(263): useful for making plants with modified plant phenotypes as described in USSN 12/139,269
  misc_feature (54)..(83): Pfam Name: zf-C3HC4; Pfam Description: Zinc finger, C3HC4 type (RING finger)
  misc_feature (54)..(83): Pfam Name: zf-C3HC4; Pfam Description: Zinc finger, C3HC4 type (RING finger)
  misc_feature (1)..(263): Utility: Useful for increasing seed/fruit yield or modifying fruit content
  misc_feature (1)..(263): Utility: Useful for making ornamental plants with modified flowers
  misc_feature (1)..(263): Utility: Useful for making plants sterile and for genetic confinement
  misc_feature (1)..(263): Utility: Useful for making plants with increased biomass and foliage
  misc_feature (1)..(263): Utility: Useful for making smaller plants
  misc_feature (1)..(263): Utility: Useful for making taller plants and plants with longer inflorescences
MLSIPDTRMWNLASSYLTGNIGPKNDIRRPVHAHAECSDDDVSSVGSKDEGLECPICWESFNIVENVPYVLWCGHTMCKNCILGLQWAIVKLPTHPVQLPLFISCPWCNLLSFRLVFRGTLRFPHKNYFVLWMVERMNGERRNSPGGAQTDGNNDHTRETPSPCLHNRHHRSQPEPSRSVNDHRIPRDNIQTSLRKSLVFFVQLTAKFPLVVIFLLIILYAIPTSAAILAMYILVTLLLALPSFLILYFAYPCLDWLVREIVT

SEQ ID NO: 6807 - protein, 264 aa, Glycine max
  misc_feature (1)..(264): useful for making plants with modified plant phenotypes as described in USSN 12/139,269
  misc_feature (1)..(264): Ceres CLONE ID no. 625275
  misc_feature (1)..(264): Utility: Useful for increasing seed/fruit yield or modifying fruit content
  misc_feature (1)..(264): Utility: Useful for making ornamental plants with modified flowers
  misc_feature (1)..(264): Utility: Useful for making plants sterile and for genetic confinement
  misc_feature (1)..(264): Utility: Useful for making plants with increased biomass and foliage
  misc_feature (1)..(264): Utility: Useful for making smaller plants
  misc_feature (1)..(264): Utility: Useful for making taller plants and plants with longer inflorescences
MWNFASNCIAGTVGLKNDSKPTHSASECSDDENSVIGREEGLECPICWESFNIVENVPYVLWCGHTLCKNCILGLQWAVVKFPTLPVQLPLFISCPWCNLLSFRLVYRGNLKFPRKNYFLLWMVESMNGDRGKSHSPFCGDNQQHSIKDNLTMGSQVSHGNLRRGLVRHPETSSSNQYHGNTGNHLNTERFHVYLRKSLIFFVQLTAKFPLVIIFLLIVLYAIPASAAILALYVLVTILFALPSFLILYFSYPSLDWLVREIIT

SEQ ID NO: 6808 - protein, 266 aa, Glycine max
  misc_feature (1)..(266): useful for making plants with modified plant phenotypes as described in USSN 12/139,269
  misc_feature (1)..(266): Ceres CLONE ID no. 1246429
  misc_feature (1)..(266): Utility: Useful for increasing seed/fruit yield or modifying fruit content
  misc_feature (1)..(266): Utility: Useful for making ornamental plants with modified flowers
  misc_feature (1)..(266): Utility: Useful for making plants sterile and for genetic confinement
  misc_feature (1)..(266): Utility: Useful for making plants with increased biomass and foliage
  misc_feature (1)..(266): Utility: Useful for making smaller plants
  misc_feature (1)..(266): Utility: Useful for making taller plants and plants with longer inflorescences
MWNFASSLIAGSVGLKNDSPKPTHSASEFSDDETSMVSREERLECPICWESFNIVENVPYVLWCGHTLCKNCILGLQWAVVNFPTLPIRLPLFISCPWCNLLSLRLVYQGNLKFPHKNYFLLWMVESMNGDRVKSHSTVCGDHQPVWPIIDSLTNGSQVSHDSLQGGQVCHPESSSSNHYHGDTSNYLSIETLHTSLRKSLVLFVHLTAKFPLIIIFLLIVLYAIPVIAAILALYILVTILFALPSFLILYFAYPSLDWLVREIIT

SEQ ID NO: 6809 - protein, 267 aa, Glycine max
  misc_feature (1)..(267): useful for making plants with modified plant phenotypes as described in USSN 12/139,269
  misc_feature (1)..(267): Public GI no. 37718893
  misc_feature (1)..(267): Utility: Useful for increasing seed/fruit yield or modifying fruit content
  misc_feature (1)..(267): Utility: Useful for making ornamental plants with modified flowers
  misc_feature (1)..(267): Utility: Useful for making plants sterile and for genetic confinement
  misc_feature (1)..(267): Utility: Useful for making plants with increased biomass and foliage
  misc_feature (1)..(267): Utility: Useful for making smaller plants
  misc_feature (1)..(267): Utility: Useful for making taller plants and plants with longer inflorescences
MWNFASSAWGSGLGKKNTPNCTPSNGDCSDDEASSCTSREEGLECPICWESFNIVENVPYVLWCGHTMCKNCILGLQWAIIKVPTVPIQLPFFVSCPWCNLLSLRIIYKGNLAFPRKNYFLLWMVEGMNGERARSRSAIHSEQQTTWLSSSSRASGNEGYSNPIRRPLPPPVETQSPSVNHANHGVPILNAERVQALLRKSLSFLVHLTAKFPLVFIFLLIVLYAIPASAAVLLLYILITVLFALPSFLILYFAYPSLDWLVREIFA

SEQ ID NO: 6810 - protein, 260 aa, Triticum aestivum
  misc_feature (1)..(260): useful for making plants with modified plant phenotypes as described in USSN 12/139,269
  misc_feature (1)..(260): Ceres CLONE ID no. 937503
  misc_feature (1)..(260): Utility: Useful for increasing seed/fruit yield or modifying fruit content
  misc_feature (1)..(260): Utility: Useful for making ornamental plants with modified flowers
  misc_feature (1)..(260): Utility: Useful for making plants sterile and for genetic confinement
  misc_feature (1)..(260): Utility: Useful for making plants with increased biomass and foliage
  misc_feature (1)..(260): Utility: Useful for making smaller plants
  misc_feature (1)..(260): Utility: Useful for making taller plants and plants with longer inflorescences
MWSFASNAIAGSIKKKVQPSKGSLSNHDCSDDDGSSCASREEGLECPICCESFNIVENVPYVLWCGHTMCKNCILGLQWAVVKFPTLPIQLPLFVSCPWCNLLSFRLVYKGNLKFPRKNYFLLWMVESMNGDRAKFHSSGHEERQSVCPSSGGTSSSQHHRRTPTARAETSSSARDRNAAANTPNTASVSLQKLMVCFVQLTAKFPLVIMFLLIVLYAVPASAAVLLLYVLVTFLFALPSFLILYFAYPTLDWLVREIFT

SEQ ID NO: 6811 - protein, 270 aa, Zea mays
  misc_feature (1)..(270): useful for making plants with modified plant phenotypes as described in USSN 12/139,269
  misc_feature (1)..(270): Ceres CLONE ID no. 1549251
  misc_feature (1)..(270): Utility: Useful for increasing seed/fruit yield or modifying fruit content
  misc_feature (1)..(270): Utility: Useful for making ornamental plants with modified flowers
  misc_feature (1)..(270): Utility: Useful for making plants sterile and for genetic confinement
  misc_feature (1)..(270): Utility: Useful for making plants with increased biomass and foliage
  misc_feature (1)..(270): Utility: Useful for making smaller plants
  misc_feature (1)..(270): Utility: Useful for making taller plants and plants with longer inflorescences
MWGFASNAWAAGLEKRSFPNRTSSSAAYSDDEASSCTSREEGLECPICWESFNIVENVPYALWCGHTMCKNCILGLQWAVIKVPTVPIQLPFFICCPWCNLLSPRVLYKGNLTFPRKNYFLLWMVEGMNGERARSRPAIRSEQHTPWLSSSSSVANGNAGCSNPTRRHLPPPSVDTSPTNANHANHGGSPLLNAGRVQASLRKSLSFLVHLTAKFPLVFVFLLIVLYAIPASAAVLLLYILITVLFALPSFLILYFAYPSLDWLVREIFA

SEQ ID NO: 6812 - DNA, 1125 bp, Arabidopsis thaliana
  misc_feature (1)..(1125): useful for making plants with modified plant phenotypes as described in USSN 12/139,269
  misc_feature (1)..(1125): Ceres CLONE ID no. 124720
  misc_feature (1)..(1125): Also known as  Ceres CDNA ID no. 23372506
attttcttctcttcttcacacaaacacacacagatctcttcttcatcacattacttctggctttacatcttttttcttctccatgaggaaagggagaggctcttccgtcgttggacccgcccttccagtaaccgccggtggatctgtgaaggagccgaggtatagaggcgttaggaagagaccttggggtcgattcgcagctgagatccgtgatccattaaaaaaatctcgtgtctggctcggtactttcgattccgccgtagatgctgcacgcgcttacgataccgccgctcgtaacctccgtggtccaaaggccaagaccaatttcccgatcgattgttctccttcttctcctctccaacctctcacctacctccacaatcaaaacctctgttctcctccggtgattcagaaccagatcgatccgtttatggaccatcggttatacggcggaggtaatttccaggagcagcagcagcagcagattattagtcggccggcgagtagcagcatgagcagcaccgttaaatcttgtagcggaccgagaccgatggaagccgcggcggcgtcttcgtcggtggcgaaaccgttacatgcgattaagagatatccgagaactccaccggtagctccggaggattgtcatagcgactgcgattcttcgtcgtctgttattgacgacggagatgatatcgcatcttcgtcttcccgccggaaaacgccgtttcagtttgatcttaatttcccgccgttggatggcgttgacttattcgctggcgggatagatgatctccactgtaccgatctacgtctctgatttgctgctttacaaaaaaaatccgttgattacacacaaaaaaaattctcaaattttacaaaatgataactttatgctcttttgtttttccattttcctttgatatcatattgaaagagaaaaaaaggaagaacaaaaaaaaaagattgagcgtgatgattttatcatcaacgaagatgatgacgattaaaaagagagagagattgtgttaagatctgttactgtaagaaccagatctgggtttcatttttatctgtttcttcttataaaagatccaacaaccctttgttacatatatataacattcc

SEQ ID NO: 6813 - protein, 244 aa, Arabidopsis thaliana
  misc_feature (1)..(244): useful for making plants with modified plant phenotypes as described in USSN 12/139,269
  misc_feature (25)..(88): Pfam Name: AP2; Pfam Description: AP2 domain
  misc_feature (1)..(244): Utility: Useful for increasing seed/fruit yield or modifying fruit content
  misc_feature (1)..(244): Utility: Useful for making ornamental plants with modified leaves
  misc_feature (1)..(244): Utility: Useful for making plants sterile and for genetic confinement
  misc_feature (1)..(244): Utility: Useful for making plants with increased biomass
  misc_feature (1)..(244): Utility: Useful for making plants with increased biomass and foliage
  misc_feature (1)..(244): Utility: Useful for making smaller plants
MRKGRGSSVVGPALPVTAGGSVKEPRYRGVRKRPWGRFAAEIRDPLKKSRVWLGTFDSAVDAARAYDTAARNLRGPKAKTNFPIDCSPSSPLQPLTYLHNQNLCSPPVIQNQIDPFMDHRLYGGGNFQEQQQQQIISRPASSSMSSTVKSCSGPRPMEAAAASSSVAKPLHAIKRYPRTPPVAPEDCHSDCDSSSSVIDDGDDIASSSSRRKTPFQFDLNFPPLDGVDLFAGGIDDLHCTDLRL

SEQ ID NO: 6814 - protein, 235 aa, Brassica napus
  misc_feature (1)..(235): useful for making plants with modified plant phenotypes as described in USSN 12/139,269
  misc_feature (1)..(235): Ceres CLONE ID no. 975672
  misc_feature (1)..(235): Utility: Useful for increasing seed/fruit yield or modifying fruit content
  misc_feature (1)..(235): Utility: Useful for making ornamental plants with modified leaves
  misc_feature (1)..(235): Utility: Useful for making plants sterile and for genetic confinement
  misc_feature (1)..(235): Utility: Useful for making plants with increased biomass
  misc_feature (1)..(235): Utility: Useful for making plants with increased biomass and foliage
  misc_feature (1)..(235): Utility: Useful for making smaller plants
  misc_feature (194)..(194): Xaa is any aa, unknown or other
  misc_feature (214)..(214): Xaa is any aa, unknown or other
  misc_feature (228)..(228): Xaa is any aa, unknown or other
  misc_feature (229)..(229): Xaa is any aa, unknown or other
  misc_feature (234)..(234): Xaa is any aa, unknown or other
FHQLQTHRSLLNHITSGSPTMRKGRGSSAVPPALPGSVKEPRYRGVRKRPWGRFAAEIRDPLKKSRVWLGTFDSAEEAARAYDAAARNLRGPKAKTNFQIDCSPSSPLQPLHHRNQIDPFMDHRLYGGEQEVVIISRPASSSMSSTVKSCSGVRPASSSVAKAATKRYPRTPPVAPEDCRSDCDSSSSVVEDGXDIASSSSRRKPPFEFDLNFXPLDGVDLFVGADDXXCTDLXL

SEQ ID NO: 6815 - protein, 208 aa, Glycine max
  misc_feature (1)..(208): useful for making plants with modified plant phenotypes as described in USSN 12/139,269
  misc_feature (1)..(208): Ceres CLONE ID no. 1044385
  misc_feature (1)..(208): Utility: Useful for increasing seed/fruit yield or modifying fruit content
  misc_feature (1)..(208): Utility: Useful for making ornamental plants with modified leaves
  misc_feature (1)..(208): Utility: Useful for making plants sterile and for genetic confinement
  misc_feature (1)..(208): Utility: Useful for making plants with increased biomass
  misc_feature (1)..(208): Utility: Useful for making plants with increased biomass and foliage
  misc_feature (1)..(208): Utility: Useful for making smaller plants
MVKEKKNVVVKNKKPNNNADELHFRGVRKRPWGRYAAEIRDPGKKTRVWLGTFDTAEDAARAYDAAARNFRGPKAKTNFPVPPDDNNNNNVNVNKNKSVNVKSHSPSQSSTVESATPEREATRRSTSAAIDRFPFLPIQQQILMTHPVAAPMRPVFFLDRAHFMTQSFPLRFEPGPVQSDSDSSSVVVDCQPKREINLDLNLAPPNEY

SEQ ID NO: 6816 - protein, 176 aa, Glycine max
  misc_feature (1)..(176): useful for making plants with modified plant phenotypes as described in USSN 12/139,269
  misc_feature (1)..(176): Public GI no. 55419650
  misc_feature (1)..(176): Utility: Useful for increasing seed/fruit yield or modifying fruit content
  misc_feature (1)..(176): Utility: Useful for making ornamental plants with modified leaves
  misc_feature (1)..(176): Utility: Useful for making plants sterile and for genetic confinement
  misc_feature (1)..(176): Utility: Useful for making plants with increased biomass
  misc_feature (1)..(176): Utility: Useful for making plants with increased biomass and foliage
  misc_feature (1)..(176): Utility: Useful for making smaller plants
MAPRSKPSPISPNPDPNSKEIRYRGVRKRPWGRYAAEIRDPRKKTRVWLGTFDTAEEAARAYDAKAREFRGAKAKTNFADNNANDFTRSPSQSSTVESSSPPPLDLTLASPCSSLPVTAQRPVYFFDAFATGGSGCPASGFAQSDSDSSSSVVDFEGGVRRRVFDLDLNQLPAEMD

SEQ ID NO: 6817 - protein, 218 aa, Glycine max; identical to SEQ ID NO: 1787
  misc_feature (1)..(218): useful for making plants with modified plant phenotypes as described in USSN 12/139,269
  misc_feature (1)..(218): Public GI no. 56384582
  misc_feature (1)..(218): Utility: Useful for increasing seed/fruit yield or modifying fruit content
  misc_feature (1)..(218): Utility: Useful for making ornamental plants with modified leaves
  misc_feature (1)..(218): Utility: Useful for making plants sterile and for genetic confinement
  misc_feature (1)..(218): Utility: Useful for making plants with increased biomass
  misc_feature (1)..(218): Utility: Useful for making plants with increased biomass and foliage
  misc_feature (1)..(218): Utility: Useful for making smaller plants

SEQ ID NO: 6818 - protein, 225 aa, Glycine max; identical to SEQ ID NO: 1788
  misc_feature (1)..(225): useful for making plants with modified plant phenotypes as described in USSN 12/139,269
  misc_feature (1)..(225): Public GI no. 57012880
  misc_feature (1)..(225): Utility: Useful for increasing seed/fruit yield or modifying fruit content
  misc_feature (1)..(225): Utility: Useful for making ornamental plants with modified leaves
  misc_feature (1)..(225): Utility: Useful for making plants sterile and for genetic confinement
  misc_feature (1)..(225): Utility: Useful for making plants with increased biomass
  misc_feature (1)..(225): Utility: Useful for making plants with increased biomass and foliage
  misc_feature (1)..(225): Utility: Useful for making smaller plants

SEQ ID NO: 6819 - protein, 190 aa, Glycine max
  misc_feature (1)..(190): useful for making plants with modified plant phenotypes as described in USSN 12/139,269
  misc_feature (1)..(190): Public GI no. 50929507
  misc_feature (1)..(190): Utility: Useful for increasing seed/fruit yield or modifying fruit content
  misc_feature (1)..(190): Utility: Useful for making ornamental plants with modified leaves
  misc_feature (1)..(190): Utility: Useful for making plants sterile and for genetic confinement
  misc_feature (1)..(190): Utility: Useful for making plants with increased biomass
  misc_feature (1)..(190): Utility: Useful for making plants with increased biomass and foliage
  misc_feature (1)..(190): Utility: Useful for making smaller plants
MVGGEVMCEAAAPRYRGVRKRPWGRFAAEIRDPAKRARVWLGTYDSAEAAARAYDVAARNLRGPLARTNFPLVSSLPLPSPHYHLPGKAAAAAPPVAGPACSASSTVESSSGPRGPRPAATAAAVPRRRVPRPAPPAPDAGCHSDCASSASVVDDADDASTVRSRVAAFDLNLPPPLDRDHVDLCTDLRL

SEQ ID NO: 6820 - protein, 211 aa, Zea mays; identical to SEQ ID NO: 1746
  misc_feature (1)..(211): useful for making plants with modified plant phenotypes as described in USSN 12/139,269
  misc_feature (1)..(211): Ceres CLONE ID no. 273307
  misc_feature (1)..(211): Utility: Useful for increasing seed/fruit yield or modifying fruit content
  misc_feature (1)..(211): Utility: Useful for making ornamental plants with modified leaves
  misc_feature (1)..(211): Utility: Useful for making plants sterile and for genetic confinement
  misc_feature (1)..(211): Utility: Useful for making plants with increased biomass
  misc_feature (1)..(211): Utility: Useful for making plants with increased biomass and foliage
  misc_feature (1)..(211): Utility: Useful for making smaller plants

SEQ ID NO: 6821 - DNA, 768 bp, Zea mays
  misc_feature (1)..(768): useful for making plants with modified plant phenotypes as described in USSN 12/139,269
  misc_feature (1)..(768): Ceres CLONE ID no. 288251
  misc_feature (1)..(768): Also known as  Ceres CDNA ID no. 23743430
gcacgagaccattacctagaacatcctaatcgaaaaataagcttctagcagcatccgccaccgccgcggaggcctatatctccccgcgtccgctagccctagccgccgcccgccgacttcatcgttgccgtcgtctagacctcttcacgcactggaaaggttaaagtccgacatcaatggcgaagcatcatcctgatctcatcatgtgccggaagcagcctggcatcgcgattggccgcctttgcgagaaatgtgatggcaagtgtgttgtctgcgactcgtacgtgcgcccatgtacgcttgtccgggtctgcgacgagtgcaattatggttcgttccagggaaggtgtgtgatctgtggaggagtcggcatctcagacgcttactactgcaaggagtgcacccagcaggagaaggaccgggacggttgccccaagatcgtgaatcttggaagcgccaagacggatctcttctatgagcgcaagaagtatggttttaagaagagatgaccgagaagatggagctgtgtgtggttcactttggctgtgtggtctgttctatggcactgaatactgagagtaggcagctgaggcagcagctttgtattcctgttatggtttgataattgatactggcatggaaatacagctgtgatatgcgttgtaataactaagtttaactgtatgatgcaagagactgcttatgtaatctgtgcttgatggtaatggttatgaatggacttgaaatattggcatgatagctgtcatc

SEQ ID NO: 6822 - protein, 110 aa, Zea mays
  misc_feature (1)..(110): useful for making plants with modified plant phenotypes as described in USSN 12/139,269
  misc_feature (1)..(106): Pfam Name: PHF5; Pfam Description: PHF5-like protein
  misc_feature (1)..(110): Utility: Useful for increasing seed/fruit yield or modifying fruit content
MAKHHPDLIMCRKQPGIAIGRLCEKCDGKCVVCDSYVRPCTLVRVCDECNYGSFQGRCVICGGVGISDAYYCKECTQQEKDRDGCPKIVNLGSAKTDLFYERKKYGFKKR

SEQ ID NO: 6823 - protein, 101 aa, Arabidopsis thaliana
  misc_feature (1)..(101): useful for making plants with modified plant phenotypes as described in USSN 12/139,269
  misc_feature (1)..(101): Ceres CLONE ID no. 94739
  misc_feature (1)..(101): Utility: Useful for increasing seed/fruit yield or modifying fruit content
MCRKQPGIAIGRLCEKCDGKCVICDSYVRPCTLVRICDECNYGSFQGRCVICGGVGISDAYYCKECTQQEKDRDGCPKIVNLGSAKTDLFYERKKYGFKKR

SEQ ID NO: 6824 - protein, 101 aa, Arabidopsis thaliana; identical to SEQ ID NO: 6823
  misc_feature (1)..(101): useful for making plants with modified plant phenotypes as described in USSN 12/139,269
  misc_feature (1)..(101): Ceres CLONE ID no. 35872
  misc_feature (1)..(101): Utility: Useful for increasing seed/fruit yield or modifying fruit content

SEQ ID NO: 6825 - protein, 101 aa, Arabidopsis thaliana; identical to SEQ ID NO: 6823
  misc_feature (1)..(101): useful for making plants with modified plant phenotypes as described in USSN 12/139,269
  misc_feature (1)..(101): Ceres CLONE ID no. 22599
  misc_feature (1)..(101): Utility: Useful for increasing seed/fruit yield or modifying fruit content

SEQ ID NO: 6826 - protein, 101 aa, Triticum aestivum
  misc_feature (1)..(101): useful for making plants with modified plant phenotypes as described in USSN 12/139,269
  misc_feature (1)..(101): Ceres CLONE ID no. 1053778
  misc_feature (1)..(101): Utility: Useful for increasing seed/fruit yield or modifying fruit content
MCRKQPGIAIGRLCEKCDGKCVICDSYVRPCTLVRVCDECNYGSFQGRCVICGGVGISDAYYCKKCTQQEKDRDGCPKIVNLGSAKTDLFYERKKYGFKKR

SEQ ID NO: 6827 - protein, 97 aa, Glycine max
  misc_feature (1)..(97): useful for making plants with modified plant phenotypes as described in USSN 12/139,269
  misc_feature (1)..(97): Ceres CLONE ID no. 855135
  misc_feature (1)..(97): Utility: Useful for increasing seed/fruit yield or modifying fruit content
  misc_feature (94)..(94): Xaa is any aa, unknown or other
MCRKQPGIAIGRLCEKCDGKCVICDSYVRPCTLVRVCDECNYGSFQGRCVICGGVGISDAYYCKECTQQEKDRDGCPKIVNLGSAKTDLFYERXKYG

SEQ ID NO: 6828 - DNA, 1425 bp, Arabidopsis thaliana
  misc_feature (1)..(1425): useful for making plants with modified plant phenotypes as described in USSN 12/139,269
  misc_feature (1)..(1425): Ceres CLONE ID no. 8014
  misc_feature (1)..(1425): Also known as  Ceres CDNA ID no. 23370386
aaatagcatctccttcagtgtctcttacagtttccgatctatccaaatcatagattcttttatcttcacaatctgttagtgtctcgtagctctaattaggtaataactaatgggagtgtcaaagaagaaatcaggtgagattagaggagatttaatcccagggttaccagaggaattaccaattgagtgtttggttagagttccttttcagtttcattcttccatcaaatctgtttgccgatcatggaaatgcgttatctccagtcgttcttttatcaaggaacggataggttttggtaaagctgaatctcttctctgccttgttcaacctctgacttcaccaccgtctccggcgatgattgaaggtggtgagatgagtcagaagaagaaagaggaagaagaaggcgagtctcagatgacgcagcagctgctacaaccgcgtattactggaacgccactttacggtttaagcgtttataacgcaacgctggacacgtggcaccgagtcgcgattcctgaacggattcctttgttctgcgaatgcgttgcgattcaggacgcggggaaagtgttgttaatcggcggttgggatccggagacgttgcagcctgtgcgagatgtttttgttctggatttctttgccggagaaggaagcggaagaaggttcagaagaggcaggccgatgtcggcggcgagatcgtttttcgcctgtgcttctgttggttcgacgaaagtttacgtcgccggaggacatgatgatcagaagaacgctctccgatcggcggaagtgtacgatgtagagaaagacgagtggtcgatgcttcctccgatgacggaaggaagagacgagtgtcacggattctcgatggcgacggatcctggattttgtgttttgagcggttatggaacggagacgcaaggccaattccgatctgacggcgagatttacgatccgattacgaattcatggtcgacaatcgagaatgtctggccgtttcccgatttgagtccgagaggtcgcaccgccgcggctgctgctgaattccccggagattttagaggttgtcggttatggtgttttattgatagcgagagacagagtcagcctcattgggaagttgaagacgattcgatgaaatggaaggtaattatggatacgattcggcttccggtgacgacgatgacttcggtttttgctggaagtttgagtggccaagcggtggcaatgattggcggtggtggtgaagaaagtggaacgatgatggtgaagacgacggcggagaagaatggcgggaagtggagccacgtcaacactccctctggtttttcgagtcttcctttctcgtgttcttcaatctacgtttgaagaatctctgttgtagaacactttgacttaagtcaacgttaatagttaatacttaatac

SEQ ID NO: 6829 - protein, 418 aa, Arabidopsis thaliana
  misc_feature (1)..(418): useful for making plants with modified plant phenotypes as described in USSN 12/139,269
  misc_feature (141)..(193): Pfam Name: Kelch_1; Pfam Description: Kelch motif
  misc_feature (195)..(242): Pfam Name: Kelch_2; Pfam Description: Kelch motif
  misc_feature (16)..(61): Pfam Name: F-box; Pfam Description: F-box domain
  misc_feature (1)..(418): Utility: Useful for increasing seed/fruit yield or modifying fruit content
MGVSKKKSGEIRGDLIPGLPEELPIECLVRVPFQFHSSIKSVCRSWKCVISSRSFIKERIGFGKAESLLCLVQPLTSPPSPAMIEGGEMSQKKKEEEEGESQMTQQLLQPRITGTPLYGLSVYNATLDTWHRVAIPERIPLFCECVAIQDAGKVLLIGGWDPETLQPVRDVFVLDFFAGEGSGRRFRRGRPMSAARSFFACASVGSTKVYVAGGHDDQKNALRSAEVYDVEKDEWSMLPPMTEGRDECHGFSMATDPGFCVLSGYGTETQGQFRSDGEIYDPITNSWSTIENVWPFPDLSPRGRTAAAAAEFPGDFRGCRLWCFIDSERQSQPHWEVEDDSMKWKVIMDTIRLPVTTMTSVFAGSLSGQAVAMIGGGGEESGTMMVKTTAEKNGGKWSHVNTPSGFSSLPFSCSSIYV

SEQ ID NO: 6830 - protein, 409 aa, Arabidopsis thaliana
  misc_feature (1)..(409): useful for making plants with modified plant phenotypes as described in USSN 12/139,269
  misc_feature (1)..(409): Public GI no. 21594431
  misc_feature (1)..(409): Utility: Useful for increasing seed/fruit yield or modifying fruit content
MTMEVSKKKGGDFQQCHDLIPGLPSELALECLVRVPFQFQSAMRSVCRSWRSLLSDSSFIQERRRCGKTELLLCLVQPLTPPIPASKSVDETLMVDEKKSEDESHPRVFCTPRFGLSVYNAAMSTWHRVAFPEEEQIPLFCECVVLQDAGKILLIGGWDPETLQPTRDVYVLEFAGRKWRRGAPMKESRSFFACASVSPTKVYVAGGHDDQKNALRSAEVYDVEKDEWSSVTPMTEGRDECQGFAVGTGLRFCVLSGYGTESQGRFRSDGEIYDPATNSWSRIDNVWRFPDTSPRGRTAGDFRSSSTLWCFTDTDLQSERRWETNDDSRNLKLDLQSIQLPMTGSSVFAGSLGGESVVMIGGKRESEGEGEGGVMMKMTTEKKMGKWSHHVHIPCDFSTLPFSHASIYV

SEQ ID NO: 6831 - protein, 407 aa, Arabidopsis thaliana
  misc_feature (1)..(407): useful for making plants with modified plant phenotypes as described in USSN 12/139,269
  misc_feature (1)..(407): Public GI no. 7486482
  misc_feature (1)..(407): Utility: Useful for increasing seed/fruit yield or modifying fruit content
MEVSKKKGGDFQQCHELIPGLPSELALECLVRVPFQFQSAMRSVCRSWRSLLSDSSFIQERRRCGKTELLLCLVQPLTPPIPASKSVDETLMVDEKKSEDESHPRVFCTPRFGLSVYNAAMSTWHRVAFPEEEQIPLFCECVVLQDAGKILLIGGWDPETLQPTRDVYVLEFAGRKWRRGAPMKESRSFFACASVSPTKVYVAGGHDDQKNALRSAEVYDVEKDEWSSVTPMTEGRDECQGFAVGMGLRFCVLSGYGTESQGRFRSDGEIYDPATDSWSRIDNVWRFPDTSPRGRTAGDFRSSSTLWCFTDTDLQSERRWETNDDSRNLKLDLQSIQLPMTGSSVFAGSLGGESVVMIGGKRESEGEGEGGVMMKMTTEKKMGKWSHHVHIPCDFSTLPFSHASIYV

SEQ ID NO: 6832 - protein, 409 aa, Arabidopsis thaliana
  misc_feature (1)..(409): useful for making plants with modified plant phenotypes as described in USSN 12/139,269
  misc_feature (1)..(409): Public GI no. 21700857
  misc_feature (1)..(409): Utility: Useful for increasing seed/fruit yield or modifying fruit content
MTMEVSKKKGGDFQQCHELIPGLPSELALECLVRVPFQFQSAMRSVCRSWRSLLSDSSFIQERRRCGKTELLLCLVQPLTPPIPASKSVDETLMVDEKKSEDESHPRVFCTPRFGLSVYNAAMSTWHRVAFPEEEQIPLFCECVVLQDAGKILLIGGWDPETLQPTRDVYVLEFAGRKWRRGAPMKESRSFFACASVSPTKVYVAGGHDDQKNALRSAEVYDVEKDEWSSVTPMTEGRDECQGFAVGMGLRFCVLSGYGTESQGRFRSDGEIYDPATDSWSRIDNVWRFPDTSPRGRTAGDFRSSSTLWCFTDTDLQSERRWETNDDSRNLKLDLQSIQLPMTGSSVFAGSLGGESVVMIGGKRESEGEGEGGVMMKMTTEKKMGKWSHHVHIPCDFSTLPFSHASIYV

SEQ ID NO: 6833 - DNA, 1379 bp, Arabidopsis thaliana
  misc_feature (1)..(1379): useful for making plants with modified plant phenotypes as described in USSN 12/139,269
  misc_feature (1)..(1379): Ceres CLONE ID no. 13186
  misc_feature (1)..(1379): Also known as  Ceres CDNA ID no. 23368442
aattccctctagtaccaaatcctattactattgaaggtatactctatagttatttatttagttaagtatatatattaaaaataaataacattaattagtactagtcttatcatatttattagctcattttcttataaaatactaatataataggaaatttaagcacaagatgagctttgcccatcgagagcctcaaaacccaaaagtctcttcttcttcacgagatccaatcttttgctttttagtaattaattacatcttcttccttctcttctctcttcttcttccctctctcatacctacctataagcaacacaaagaacaccattgatcccatctgttttgttccctatatttcgttaatccatccatacgcattccaactacacgctttttgtatgcaaccccaaatagcagcttaaagaaagcagagaggatcttcttttatttcccctctgagcaacagaagccattattcaaagaaaggcttctttaatttactcgcagggagagggaaaagagaaaaaattgaaaaactccattttcaagtcattaaaatggcatcttcttcaacaaactcaccatgcgccgcttgcaaattcctccggcgaaaatgtcaaccggaatgtgtattcgcgccctatttcccaccggaccagccacaaaaattcgcaaacgttcacaaagtgtttggagcaagtaacgtgacaaagctcctcaacgagcttcacccttcacaacgtgaagacgcagtgaactctttggcctatgaagccgacatgcgcctccgtgaccctgtctacggctgcgttggcgtcatctctctcctccaacatcagcttcgtcagcttcagatagatctcagctgtgctaaatctgagctctctaagtaccaaagcctcggtatcctcgccgccactcatcagagtcttggcatcaacttactcgccggagcagcagatggaacagccaccgccgtgagagaccactatcaccaccaccagttttttcctagagaacaaatgtttggtggcttggatgttccggccggtaacaactacgacggtgggattcttgccattggacagatcactcagtttcagcagccgagagccgccgctggagatgatggtcgccgtactgttgatccgtcttgagattttagggttttggtggtgttcatcttcgtcgatcgcttggtgatgagaaaactataattttaagaaaatatttgatgtggaaaaccaaaatattttaaacgtatggtacgtctctcttaatgacattaatttcggtttttattattattattacttagatatattatgatagtcacttttgtatttctttcaaattttatggacttgctctcttaattg

SEQ ID NO: 6834 - protein, 199 aa, Arabidopsis thaliana
  misc_feature (1)..(199): useful for making plants with modified plant phenotypes as described in USSN 12/139,269
  misc_feature (9)..(109): Pfam Name: DUF260; Pfam Description: Protein of unknown function DUF260
  misc_feature (1)..(199): Utility: Useful for increasing seed/fruit yield or modifying fruit content
  misc_feature (1)..(199): Utility: Useful for making larger plants
  misc_feature (1)..(199): Utility: Useful for making ornamental plants with modified flowers
  misc_feature (1)..(199): Utility: Useful for making ornamental plants with modified leaves
  misc_feature (1)..(199): Utility: Useful for making plants with altered leaf shape eg curled leaves
  misc_feature (1)..(199): Utility: Useful for making plants with increased biomass
  misc_feature (1)..(199): Utility: Useful for making plants with increased biomass and foliage
  misc_feature (1)..(199): Utility: Useful for making shorter plants and plants with modified flowers
  misc_feature (1)..(199): Utility: Useful for making smaller plants
MASSSTNSPCAACKFLRRKCQPECVFAPYFPPDQPQKFANVHKVFGASNVTKLLNELHPSQREDAVNSLAYEADMRLRDPVYGCVGVISLLQHQLRQLQIDLSCAKSELSKYQSLGILAATHQSLGINLLAGAADGTATAVRDHYHHHQFFPREQMFGGLDVPAGNNYDGGILAIGQITQFQQPRAAAGDDGRRTVDPS

SEQ ID NO: 6835 - DNA, 640 bp, Arabidopsis thaliana
  misc_feature (1)..(640): useful for making plants with modified plant phenotypes as described in USSN 12/139,269
  misc_feature (1)..(640): Ceres CLONE ID no. 16204
  misc_feature (1)..(640): Also known as  Ceres CDNA ID no. 23358452
aatcgtcgtctctccccaattcaaaaaaagaaataacctaaacgtgttcacacagagatctcgagatgaaagataaccaaacggaagttgaatcgaggagcactgatgatagattgaaagttagagggaacaaagttggaaagaaaacaaaggatccaaacaggcctaagaaaccaccaagtcctttcttcgtcttcctggacgatttccgaaaggagtttaatctggctaaccctgacaacaaatccgtcggtaatgttggtagagcagctggaaagaaatggaaaaccatgactgaggaagaaagagcaccttttgtagcaaaatcacagagcaaaaagactgagtatgctgtgactatgcaacagtataacatggaactggctaatggaaacaagacaactggagatgatgagaaacaagagaaagctgctgatgattaggaagttggatcagtgatttgtgtatcaactatatctgttgttttatgtcaacttttagctagcttttagggagaacaattgttacattcctgttttatcctttctgtcaactgtgggattattcagatgtaactttggatttagctttgagcttcaattccaccttttatgagatcatatcatatgtttgcaatctt

SEQ ID NO: 6836 - protein, 125 aa, Arabidopsis thaliana
  misc_feature (1)..(125): useful for making plants with modified plant phenotypes as described in USSN 12/139,269
  misc_feature (34)..(103): Pfam Name: HMG_box; Pfam Description: HMG (high mobility group) box
  misc_feature (1)..(125): Utility: Useful for increasing seed/fruit yield or modifying fruit content
  misc_feature (1)..(125): Utility: Useful for making ornamental plants with modified flowers
  misc_feature (1)..(125): Utility: Useful for making ornamental plants with modified leaves
  misc_feature (1)..(125): Utility: Useful for making plants sterile and for genetic confinement
  misc_feature (1)..(125): Utility: Useful for making plants with increased biomass
MKDNQTEVESRSTDDRLKVRGNKVGKKTKDPNRPKKPPSPFFVFLDDFRKEFNLANPDNKSVGNVGRAAGKKWKTMTEEERAPFVAKSQSKKTEYAVTMQQYNMELANGNKTTGDDEKQEKAADD

SEQ ID NO: 6837 - protein, 140 aa, Brassica napus
  misc_feature (1)..(140): useful for making plants with modified plant phenotypes as described in USSN 12/139,269
  misc_feature (1)..(140): Ceres CLONE ID no. 956177
  misc_feature (1)..(140): Utility: Useful for increasing seed/fruit yield or modifying fruit content
  misc_feature (1)..(140): Utility: Useful for making ornamental plants with modified flowers
  misc_feature (1)..(140): Utility: Useful for making ornamental plants with modified leaves
  misc_feature (1)..(140): Utility: Useful for making plants sterile and for genetic confinement
  misc_feature (1)..(140): Utility: Useful for making plants with increased biomass
MKGGESKAQAKSTDERLKTRGKKAGKKVKDPNKPKRPPSAFFVFLEGFRKEFNLANPDNKSVGAVGKAAGAKWKSMTAEDKAPYVAKAETKKTEYAKTMQKYNMKLANGTSTAGDDDSDKSKSEVNDEEDAASDEEEDDD

SEQ ID NO: 6838 - protein, 152 aa, Glycine max
  misc_feature (1)..(152): useful for making plants with modified plant phenotypes as described in USSN 12/139,269
  misc_feature (1)..(152): Ceres CLONE ID no. 721511
  misc_feature (1)..(152): Utility: Useful for increasing seed/fruit yield or modifying fruit content
  misc_feature (1)..(152): Utility: Useful for making ornamental plants with modified flowers
  misc_feature (1)..(152): Utility: Useful for making ornamental plants with modified leaves
  misc_feature (1)..(152): Utility: Useful for making plants sterile and for genetic confinement
  misc_feature (1)..(152): Utility: Useful for making plants with increased biomass
MKGGKSKTESKRADAKLAVNKKGAATKTRKPAGKGKAAKDPNKPKRPPSAFFVFMEEFRKVFNKEHPDNKAVSAVGKAAGAKWKTMSDAEKAPYVAKSEKRKVEYEKNMRAYNKKQAEGPTGGDEEESEKSVSEVNDEDDDEEGSGEEEDDD

SEQ ID NO: 6839 - protein, 152 aa, Glycine max
  misc_feature (1)..(152): useful for making plants with modified plant phenotypes as described in USSN 12/139,269
  misc_feature (1)..(152): Public GI no. 18645
  misc_feature (1)..(152): Utility: Useful for increasing seed/fruit yield or modifying fruit content
  misc_feature (1)..(152): Utility: Useful for making ornamental plants with modified flowers
  misc_feature (1)..(152): Utility: Useful for making ornamental plants with modified leaves
  misc_feature (1)..(152): Utility: Useful for making plants sterile and for genetic confinement
  misc_feature (1)..(152): Utility: Useful for making plants with increased biomass
MKGGKSKTESKRADPKLAVNKKGAATKARKPAGKGKAAKDPNKPKRPPSAFFVFMEEFRKVFNKEHPENKAVSAVGKAAGAKWKTMSDAEKAPYVAKSEKRKVEYEKNMRAYNKKQAEGPTGGDEEESEKSVSEVNDEDDDEEGSGEEEDDD

SEQ ID NO: 6840 - protein, 98 aa, Glycine max
  misc_feature (1)..(98): useful for making plants with modified plant phenotypes as described in USSN 12/139,269
  misc_feature (1)..(98): Ceres CLONE ID no. 641329
  misc_feature (1)..(98): Utility: Useful for increasing seed/fruit yield or modifying fruit content
  misc_feature (1)..(98): Utility: Useful for making ornamental plants with modified flowers
  misc_feature (1)..(98): Utility: Useful for making ornamental plants with modified leaves
  misc_feature (1)..(98): Utility: Useful for making plants sterile and for genetic confinement
  misc_feature (1)..(98): Utility: Useful for making plants with increased biomass
MEEFRKVFNKEHPDNKAVSAVGKAAGAKWKTMSDAEKAPYVAKSEKRKVEYEKNMRAYNKKQAEGPTGGDEEESEKSVSEVNDEDDDEEGSGEEEDDD

SEQ ID NO: 6841 - protein, 98 aa, Glycine max
  misc_feature (1)..(98): useful for making plants with modified plant phenotypes as described in USSN 12/139,269
  misc_feature (1)..(98): Ceres CLONE ID no. 782784
  misc_feature (1)..(98): Utility: Useful for increasing seed/fruit yield or modifying fruit content
  misc_feature (1)..(98): Utility: Useful for making ornamental plants with modified flowers
  misc_feature (1)..(98): Utility: Useful for making ornamental plants with modified leaves
  misc_feature (1)..(98): Utility: Useful for making plants sterile and for genetic confinement
  misc_feature (1)..(98): Utility: Useful for making plants with increased biomass
MEEFRKVFNKEHPENKAVSAVGKAAGAKWKTMSDAEKAPYVAKSEKRKVEYEKNMRAYNKKQAEGPTGGDEEESEKSVSEVNDEDDDEEGSGEEEDDD

SEQ ID NO: 6842 - protein, 146 aa, Glycine max
  misc_feature (1)..(146): useful for making plants with modified plant phenotypes as described in USSN 12/139,269
  misc_feature (1)..(146): Public GI no. 1052956
  misc_feature (1)..(146): Utility: Useful for increasing seed/fruit yield or modifying fruit content
  misc_feature (1)..(146): Utility: Useful for making ornamental plants with modified flowers
  misc_feature (1)..(146): Utility: Useful for making ornamental plants with modified leaves
  misc_feature (1)..(146): Utility: Useful for making plants sterile and for genetic confinement
  misc_feature (1)..(146): Utility: Useful for making plants with increased biomass
MKGGKSKAKSDNKLAVKKRGCETKKSKKSVKDPNKPKRPPSAFFVFMEDFRKTYKEKHPNNKSVAAVGKAGGDKWKQLTDAEKAPFIAKAEKRKQEYEKSMQAYNRKQAGEAADEEESDKSRSEVNDDEEDEDGSAEDDDDDDDDE

SEQ ID NO: 6843 - protein, 154 aa, Glycine max
  misc_feature (1)..(154): useful for making plants with modified plant phenotypes as described in USSN 12/139,269
  misc_feature (1)..(154): Public GI no. 436424
  misc_feature (1)..(154): Utility: Useful for increasing seed/fruit yield or modifying fruit content
  misc_feature (1)..(154): Utility: Useful for making ornamental plants with modified flowers
  misc_feature (1)..(154): Utility: Useful for making ornamental plants with modified leaves
  misc_feature (1)..(154): Utility: Useful for making plants sterile and for genetic confinement
  misc_feature (1)..(154): Utility: Useful for making plants with increased biomass
MKGGKSKGESKKAETKLAVNKKGAPATKGGKKPAKGKEPKDPNKPKRPPSAFFVFMEDFRKQFKKGNADNKAVSAVGKAAGAKWKSMTEAEKAPYAAKAEKRKAEYEKSMKSYNKKQAEGPAAVEEEEESEKSESEVHDENDDEEESEEEDDDE

SEQ ID NO: 6844 - protein, 149 aa, Glycine max
  misc_feature (1)..(149): useful for making plants with modified plant phenotypes as described in USSN 12/139,269
  misc_feature (1)..(149): Public GI no. 729737
  misc_feature (1)..(149): Utility: Useful for increasing seed/fruit yield or modifying fruit content
  misc_feature (1)..(149): Utility: Useful for making ornamental plants with modified flowers
  misc_feature (1)..(149): Utility: Useful for making ornamental plants with modified leaves
  misc_feature (1)..(149): Utility: Useful for making plants sterile and for genetic confinement
  misc_feature (1)..(149): Utility: Useful for making plants with increased biomass
MKGGKSKGESKKAETKLAVNKKGAAATKGGKKPAKGKEPKDPNKPKRPPSAFFVFMADFREQYKKDHPNNKSVAAVGKACGEEWKSLSEEEKAPYVDRALKKKEEYEITLQAYNKKLEGKDDEEGSDKSKSEVNDEDEDEEDEEDEDDD

SEQ ID NO: 6845 - protein, 145 aa, Brassica napus
  misc_feature (1)..(145): useful for making plants with modified plant phenotypes as described in USSN 12/139,269
  misc_feature (1)..(145): Ceres CLONE ID no. 1060767
  misc_feature (1)..(145): Utility: Useful for increasing seed/fruit yield or modifying fruit content
  misc_feature (1)..(145): Utility: Useful for making ornamental plants with modified flowers
  misc_feature (1)..(145): Utility: Useful for making ornamental plants with modified leaves
  misc_feature (1)..(145): Utility: Useful for making plants sterile and for genetic confinement
  misc_feature (1)..(145): Utility: Useful for making plants with increased biomass
MKGGKSKTETRSSKLSVAKKPAKAAGRSKAAAKDPNKPKRPASAFFVFMEDFRQTYKKDHPNNKSVAAVGKAGGEKWKSLSDSEKAPFVAKADKRKVEYEKTMKAYNKKLEEGPKEDEEESDKSVSEVNDEDDADDGSDEEEDDD

SEQ ID NO: 6846 - DNA, 1048 bp, Arabidopsis thaliana
  misc_feature (1)..(1048): useful for making plants with modified plant phenotypes as described in USSN 12/139,269
  misc_feature (1)..(1048): Ceres CLONE ID no. 101250
  misc_feature (1)..(1048): Also known as  Ceres CDNA ID no. 23646538
aacacaccgaaaactgaatcaaatctcctagctcttctacgcaaaatcgagtgcatcgacaatggcggaacgtggtgtcgaacgtggtggagatcgcggcgatttcggacgtggattcggtggtcgcggcggtggaagaggtggtccgagaggtcgtggtcgccgtgcaggtcgtgctccagaggaggagaaatgggtgccagtgactaagcttggtcgtctcgtaaaggaaggtaagatcacaaagattgagcagatctacctccattctctcccagtcaaggagtaccagatcatagatttactcgtcggtccttcattgaaagacgaagtgatgaaaatcatgccggttcaaaaacaaaccagagccggtcagagaacgagattcaaggccttcatcgtcgtcggagatagtaacggtcacgtcggattaggagtcaaatgctccaaggaagttgcgacggcgatcagaggcgcgatcattctcgcgaaattgtctgtggttccgatacgaagaggttattggggtaacaagattggaaaaccacatacggttccgtgtaaggtaaccgggaaatgtggatctgttactgtacgtatggttccagctccgagaggttctggtattgtggcggctagagttcctaagaaggttcttcaattcgctggaattgatgatgtctttacttcttctagaggatccaccaaaactcttggaaacttcgtcaaggcaacatttgattgtctgcagaagacatacggattccttacaccggaattctggaaagagacgagattctcaaaatcaccataccaagagcacactgatttcttgcttatacctcctggcgtcaagatcagcgaggttgttgtagacaaaagcgtagagtaataccactttatcttgttacatgagacttgagtgttgtcaaaagctcaagtcagattttgttccaaccttggttttttgatttgtcggttataatgtctttagtaatctagatacgtatctgttttacactttgaattcaatcatacgaatcttctt

SEQ ID NO: 6847 - protein, 276 aa, Arabidopsis thaliana
  misc_feature (1)..(276): useful for making plants with modified plant phenotypes as described in USSN 12/139,269
  misc_feature (86)..(152): Pfam Name: Ribosomal_S5; Pfam Description: Ribosomal protein S5, N-terminal domain
  misc_feature (169)..(242): Pfam Name: Ribosomal_S5_C; Pfam Description: Ribosomal protein S5, C-terminal domain
  misc_feature (1)..(276): Utility: Useful for increasing seed/fruit yield or modifying fruit content
  misc_feature (1)..(276): Utility: Useful for making plants sterile and for genetic confinement
MAERGVERGGDRGDFGRGFGGRGGGRGGPRGRGRRAGRAPEEEKWVPVTKLGRLVKEGKITKIEQIYLHSLPVKEYQIIDLLVGPSLKDEVMKIMPVQKQTRAGQRTRFKAFIVVGDSNGHVGLGVKCSKEVATAIRGAIILAKLSVVPIRRGYWGNKIGKPHTVPCKVTGKCGSVTVRMVPAPRGSGIVAARVPKKVLQFAGIDDVFTSSRGSTKTLGNFVKATFDCLQKTYGFLTPEFWKETRFSKSPYQEHTDFLLIPPGVKISEVVVDKSVE

SEQ ID NO: 6848 - protein, 279 aa, Zea mays
  misc_feature (1)..(279): useful for making plants with modified plant phenotypes as described in USSN 12/139,269
  misc_feature (1)..(279): Ceres CLONE ID no. 295792
  misc_feature (1)..(279): Utility: Useful for increasing seed/fruit yield or modifying fruit content
  misc_feature (1)..(279): Utility: Useful for making plants sterile and for genetic confinement
MAERGGERGGERGGERGGFGRGFGRGGRGDRGGRRGGRRGGRQQEEEKWVPVTKLGRLVKENRINKIEEIYLHSLPVKEHQIVETLVPGLKDEVMKITPVQKQTRAGQRTRFKAFVVVGDGDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWAETKYAKTPFQEFTDLLAKPTKGLLIEAPTETVEA

SEQ ID NO: 6849 - protein, 279 aa, Zea mays; identical to SEQ ID NO: 6848
  misc_feature (1)..(279): useful for making plants with modified plant phenotypes as described in USSN 12/139,269
  misc_feature (1)..(279): Ceres CLONE ID no. 285704
  misc_feature (1)..(279): Utility: Useful for increasing seed/fruit yield or modifying fruit content
  misc_feature (1)..(279): Utility: Useful for making plants sterile and for genetic confinement

SEQ ID NO: 6850 - protein, 278 aa, Triticum aestivum
  misc_feature (1)..(278): useful for making plants with modified plant phenotypes as described in USSN 12/139,269
  misc_feature (1)..(278): Ceres CLONE ID no. 557178
  misc_feature (1)..(278): Utility: Useful for increasing seed/fruit yield or modifying fruit content
  misc_feature (1)..(278): Utility: Useful for making plants sterile and for genetic confinement
MADRGGERGGDRGGERGGFGRGFGRGGRGDRGGRRGGRRGPRQEEEKWVPVTKLGRLVKEGRFTKMEELYLHSLPIKEHQIVEQLCPGLKDEVMKITPVQKQTRAGQRTRFKAFVVVGDSNGHVGLGVKCAKEVATAIRGAIILAKLSIVPVRRGYWGNKIGLPHTVPCKVTGKCGSVTVRMVPAPRGSGIVAARVPKKVLQFAGIDDVFTSSRGSTKTLGNFVKATFDCLMKTYGFLTPDFWRETTFTKAPYQEFTDILVKPTKALMLDAPAEKIEA

SEQ ID NO: 6851 - protein, 278 aa, Triticum aestivum
  misc_feature (1)..(278): useful for making plants with modified plant phenotypes as described in USSN 12/139,269
  misc_feature (1)..(278): Ceres CLONE ID no. 754768
  misc_feature (1)..(278): Utility: Useful for increasing seed/fruit yield or modifying fruit content
  misc_feature (1)..(278): Utility: Useful for making plants sterile and for genetic confinement
MADRGGERGGDRGGERGGFGRGFGRGGRGDRGGRRGGRRGPRQEEEKWVPVTKLGRLVKEGRFTKMEELYLHSLPIKEHQIVEQLCPGLKDEVMKITPVQKQTRAGQRTRFKAFVVVGDSNGHVGLGVKCAKEVATAIRGAIILAKLSIVPVRRGYWGNKIGLPHTVPCKVTGKCGSVTVRMVPAPRGSGIVAARVPKKVLQFAGIDDVFTSSRGSTKTLGNFVKATFDCLMKTYGFLTPDFWRETTFTKAPYQEFTDILAKPTKALMLDAPAEKIEA

SEQ ID NO: 6852 - DNA, 1590 bp, Zea mays
  misc_feature (1)..(1590): useful for making plants with modified plant phenotypes as described in USSN 12/139,269
  misc_feature (1)..(1590): Ceres CLONE ID no. 283597
  misc_feature (1)..(1590): Also known as  Ceres CDNA ID no. 23758447
aggcaggcaggcaccgcacgaggcctccatttggaccaccgggaccagaacccgatcgggcacggcggagaacgcgacgaagcataaaataagccatcacaactgcatttaaagcaaggcttcccactgagccgaaggtcctgagttcgacacagtctctcttcaaaaaatacaggggtacccaggctctaataatttgtacaaaaccgatggaaacttctaaatctcctcaatcgtcaaagaacagtcatattgtggtgccttctgatagtaatggcccccgatttgacaatgatggtttttcttcagaagctgcatcaaatcaaatggtcgttttcaactctgaagcaggagataaagagcaagatgaactgggggaaaaccgtttgcagaagtcaatcataacaaggggaatatcgccatctattggagcattcactgtccaatgtgctaaatgttttaaatggaggcttattccaacgaaagagaagtatgaagaaattcgtgaacgtattatagaggaaccttttgtatgcaaaagagctcgtgaatggagacctgatgtaacatgcaatgacccagaagatatatctcaggatggtagcaggctttgggctattgacaaacccaatattgcacaaccccctcgcggatgggaaaggcagattaggataagaggtgaagggggtaccaaatttgctgatgtatactatacctctcctactggaaggaaacttaggtctctggttgaagtcgataggttcctccaagagaatccggagtatggtgctcagggtgtaactttagctcagttttcgttccagatacctagacctctacggcaggactatgtgaaaaagaaaccgaagttgataaatccaagtgatgaagcaagtatgattgcctctaagtcttttcaaccagaagaagtgaaacccatagcctgggcagttgctacaaaacacgagggcgatgccagtgaagaagcttctctcaccgatgaggcacctacatcagaagtcatgctagcccggaagagaaaagcaggaagctctttgtcgatagagccaaaccatctctctgatgaacttgaaccaaagctggaggatgcttagaacggggagacgtctaccttataagtaaaagttagcagcatcgtgatgccaactgccccctatcatggttttattggccctctgcttgtttctcatttccctttggagccagtttctctgttttgcgaggtcacacaagccttatttgtagtattacaacacagaagctggctgacccaaaatccgacactctgggggcagcaacttaacaaaatgtttgtacgagggtttagagccccacggtgcttctttggataagtatgtttattaccttgtacttagctaggaacctgcttatatgtaagatctttgtgtacgacggagaattgtcacagcggcataattctggtgcatcttggatttaatctcctgttctttgttagaccggccagtaggcagtagcaaaggttttgaaatgtctcaagttatataactactgtggtattgctagtgtaattctctgagcatgtttttt

SEQ ID NO: 6853 - protein, 301 aa, Zea mays
  misc_feature (1)..(301): useful for making plants with modified plant phenotypes as described in USSN 12/139,269
  misc_feature (75)..(128): Pfam Name: zf-CW; Pfam Description: CW-type Zinc Finger
  misc_feature (135)..(212): Pfam Name: MBD; Pfam Description: Methyl-CpG binding domain
  misc_feature (1)..(301): Utility: Useful for increasing seed/fruit yield or modifying fruit content
  misc_feature (1)..(301): Utility: Useful for making plants with increased biomass
  misc_feature (1)..(301): Utility: Useful for making plants with modified flowers
  misc_feature (1)..(301): Utility: Useful for making smaller plants
METSKSPQSSKNSHIVVPSDSNGPRFDNDGFSSEAASNQMVVFNSEAGDKEQDELGENRLQKSIITRGISPSIGAFTVQCAKCFKWRLIPTKEKYEEIRERIIEEPFVCKRAREWRPDVTCNDPEDISQDGSRLWAIDKPNIAQPPRGWERQIRIRGEGGTKFADVYYTSPTGRKLRSLVEVDRFLQENPEYGAQGVTLAQFSFQIPRPLRQDYVKKKPKLINPSDEASMIASKSFQPEEVKPIAWAVATKHEGDASEEASLTDEAPTSEVMLARKRKAGSSLSIEPNHLSDELEPKLEDA

SEQ ID NO: 6854 - protein, 258 aa, Zea mays
  misc_feature (1)..(258): useful for making plants with modified plant phenotypes as described in USSN 12/139,269
  misc_feature (1)..(258): Ceres CLONE ID no. 407007
  misc_feature (1)..(258): Utility: Useful for increasing seed/fruit yield or modifying fruit content
  misc_feature (1)..(258): Utility: Useful for making plants with increased biomass
  misc_feature (1)..(258): Utility: Useful for making plants with modified flowers
  misc_feature (1)..(258): Utility: Useful for making smaller plants
MVVFNSEAADELGENRLQKSVITKGISPSIGAFTVQCAKCFKWRLIPTKEKYEEIRERIIQEPFVCKRAREWRPDITCNDPEDISQDGSRLWAIDKPNIAQPPHGWERQIRIRGEGGTKFADVYYTSPTGRKLRSLVEVDRFLQENPEHVAQGVTLAQFSFQIPRPLRQDYVKKKPKLINASDEASTITSKSSEPEEVNPIAWAVPTKHEGDASEEASFADETLASEVVLTRKRKIGSSLSVEPNHLSDELEPKLEDA

SEQ ID NO: 6855 - protein, 258 aa, Zea mays
  misc_feature (1)..(258): useful for making plants with modified plant phenotypes as described in USSN 12/139,269
  misc_feature (1)..(258): Ceres CLONE ID no. 225383
  misc_feature (1)..(258): Utility: Useful for increasing seed/fruit yield or modifying fruit content
  misc_feature (1)..(258): Utility: Useful for making plants with increased biomass
  misc_feature (1)..(258): Utility: Useful for making plants with modified flowers
  misc_feature (1)..(258): Utility: Useful for making smaller plants
MVVFNSEAADELGENRLQKSVITKGISPSIGAFTVQCAKCFKWRLIPTKEKYEEIRERIIQEPFVCKRAREWRPDITCNDPEDISQDGSRLWAIDKPNIAQPPHGWERQIRIRGEGGTKFADVYYTSPTGRKLRSLVEVDRFLQENPEHVAQGVTLAQFSFQIPRPLRQDYVKKKPKLINASDEASTITSKSYEPEEVNPIAWAVPTKHEGDASEEASFADETLASEVVLTRKRKIGSSLSVEPNHLSDELEPKLEDA

SEQ ID NO: 6856 - protein, 297 aa, Zea mays
  misc_feature (1)..(297): useful for making plants with modified plant phenotypes as described in USSN 12/139,269
  misc_feature (1)..(297): Public GI no. 13936312
  misc_feature (1)..(297): Utility: Useful for increasing seed/fruit yield or modifying fruit content
  misc_feature (1)..(297): Utility: Useful for making plants with increased biomass
  misc_feature (1)..(297): Utility: Useful for making plants with modified flowers
  misc_feature (1)..(297): Utility: Useful for making smaller plants
MESSKSPQSSKNSRIVVPSDSNRSRFDNDGFSSETASNQMVVFNSEAADELGENRLQKSVITKGISPSIGAFTVQCAKCFKWRLIPTKEKYEEIRERIIQEPFVCKRAREWRPDITCNDPEDISQDGSRLWAIDKPNIAQPPHGWERQIRIRGEGGTKFADVYYTSPTGRKLRSLVEVDRFLQENPEHVAQGVTLAQFSFQIPRPLRQDYVKKKPKLINASDEASTITSKSSEPEEVNPIAWAVPTKHEGDASEEASFADETLASEVVLTRKRKIGSSLSVEPNHLSDELEPKLEDA

SEQ ID NO: 6857 - protein, 270 aa, Arabidopsis thaliana
  misc_feature (1)..(270): useful for making plants with modified plant phenotypes as described in USSN 12/139,269
  misc_feature (1)..(270): Ceres CLONE ID no. 40501
  misc_feature (1)..(270): Utility: Useful for increasing seed/fruit yield or modifying fruit content
  misc_feature (1)..(270): Utility: Useful for making plants with increased biomass
  misc_feature (1)..(270): Utility: Useful for making plants with modified flowers
  misc_feature (1)..(270): Utility: Useful for making smaller plants
MSQSRAVQRSSSPNEDRGENQLVVYDLKGNDDTEEEVLPVQSQPLSSRTQCPSIGAFTVQCASCFKWRLMPSMQKYEEIREQLLENPFFCDTAREWKPDISCDVPADIYQDGTRLWAIDKPNISRPPAGWQRLLRIRGEGGTRFADVYYVAPSGKKLRSTVEVQKYLNDNSEYIGEGVKLSQFSFQIPKPLQDDYVRKRPARLLDSIDNTNTPVAKEANPLAWISPDDHISLQLGTPTESGLNNSHYQPSKKKKTSTLSIFGSNDELADR

SEQ ID NO: 6858 - protein, 272 aa, Arabidopsis thaliana
  misc_feature (1)..(272): useful for making plants with modified plant phenotypes as described in USSN 12/139,269
  misc_feature (1)..(272): Public GI no. 21593605
  misc_feature (1)..(272): Utility: Useful for increasing seed/fruit yield or modifying fruit content
  misc_feature (1)..(272): Utility: Useful for making plants with increased biomass
  misc_feature (1)..(272): Utility: Useful for making plants with modified flowers
  misc_feature (1)..(272): Utility: Useful for making smaller plants
MSMSQSRAVQRSSSPNEDRGENQLVVYDLKGNDDTEEEVLPVQSQPLSSRTQCPSIGAFTVQCASCFKWRLMPSMQKYEEIREQLLENPFFCDTAREWKPDISCDVPADIYQDGTRLWAIDKPNISRPPAGWQRLLRIRGEGGTRFADVYYVAPSGKKLRSTVEVQKYLNDNSEYIGEGVKLSQFSFQIPKPLQDDYVRKRPARLLDSIDNTNTPVAKEANPLAWISPDDHISLQLGTPTESGLNNSHYQPSKKKKTSTLSIFGSNDELADR

SEQ ID NO: 6859 - DNA, 1560 bp, Zea mays
  misc_feature (1)..(1560): useful for making plants with modified plant phenotypes as described in USSN 12/139,269
  misc_feature (1)..(1560): Ceres CLONE ID no. 292789
  misc_feature (1)..(1560): Also known as  Ceres CDNA ID no. 24234794
tcattcggcctatcacaaccacttactctcgtgcgctctccgtgggagcgaggactcgcggccggcggcagcggcaggttctcctagatctccggcatcatcagtaacaaatggctgacggtgaggacattcagccccttgtttgtgacaatggaactggcatggtcaaggctggttttgctggtgacgatgcgccaagggctgttttcccaagcattgtcggacgcccccgtcacactggtgtgatggttggcatggggcagaaggatgcgtatgttggtgacgaggcccagtccaagaggggtatcctgactttgaagtaccccatcgaacatggtattgttagcaattgggatgacatggagaagatctggcaccacaccttctataatgaactccgtgtggcgcctgaagagcaccctgtgctgctgacggaagccccactcaaccccaaagctaacagggagaagatgacccaaatcatgtttgagaccttcaatgttcctgccatgtatgtcgccatccaggctgtgctttccctgtacgccagtgggcgtacaactggtattgtgttggactctggtgatggtgtcagccacaccgtgccaatctacgaaggttatgcccttcctcatgccatcctgcgtcttgaccttgctgggcgtgacctgactgacagcctgatgaagatcctcaccgagagaggttactccttcaccaccacggccgaacgggaaatcgtacgggacatcaaggaaaagcttgcatacgtggctcttgactatgatcaggagctggagaacgccaagagcagctcatctgtggagaagagctacgagctgcctgatggccaggtgatcaccattggggcggagaggttccgatgccccgaggtcctcttccagccttccttcattggtatggaagctcctggcatccatgagaccacctacaactccatcatgaaatgcgacgtggatatcaggaaggacttgtatggtaacattgttctcagtggtggcacaaccatgttccctggcatcgctgaccgtatgagcaaggagatcaccgcccttgccccgagcagcatgaaaatcaaggtggtggctccacccgagaggaaatacagtgtctggataggagggtccatccttgcctccctgagcaccttccaacagatgtggatctcaaaggctgagtacgatgagtcaggaccagcgattgttcaccggaagtgcttctaagctcaagggcccccttcgtccccattctatgtattcctttccttgagtgcttttcttataagctactatgtttgagattgccggcctttgagcaggcaatgttgttggatctgtatcttgtggatcactacaatgcatgcgttgctccatcttcttttcatgccaagtttgctgtcatacttgctagtggggaaaacaacaatgacaacagtggtgagaacagcaaccacaaaaaaagagaggatggaaattattgaagttcctaggatcgtattgtaactgtacttgtgcgagtaacattattggttctctttgc

SEQ ID NO: 6860 - protein, 377 aa, Zea mays
  misc_feature (1)..(377): useful for making plants with modified plant phenotypes as described in USSN 12/139,269
  misc_feature (8)..(377): Pfam Name: Actin; Pfam Description: Actin
  misc_feature (1)..(377): Utility: Useful for increasing seed/fruit yield or modifying fruit content
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making plants with increased biomass
  misc_feature (1)..(377): Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYDQELENAKSSSSVEKSYELPDGQVITIGAERFRCPEVLFQPSFIGMEAPGIHETTYNSIMKCDVDIRKDLYGNIVLSGGTTMFPGIADRMSKEITALAPSSMKIKVVAPPERKYSVWIGGSILASLSTFQQMWISKAEYDESGPAIVHRKCF

SEQ ID NO: 6861 - protein, 377 aa, Zea mays
  misc_feature (1)..(377): useful for making plants with modified plant phenotypes as described in USSN 12/139,269
  misc_feature (1)..(377): Ceres CLONE ID no. 996136
  misc_feature (1)..(377): Utility: Useful for increasing seed/fruit yield or modifying fruit content
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making plants with increased biomass
  misc_feature (1)..(377): Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALEYDQELENAKSSSSVEKSYELPDGQVITIGAERFRCPEVLFQPSFIGMEAPGIHETTYNSIMKCDVDIRKDLYGNIVLSGGTTMFPGIADRMSKEITALAPSSMKIKVVAPPERKYSVWIGGSILASLSTFQQMWISKAEYDESGPGIVHRKCF

SEQ ID NO: 6862 - protein, 377 aa, Zea mays
  misc_feature (1)..(377): useful for making plants with modified plant phenotypes as described in USSN 12/139,269
  misc_feature (1)..(377): Public GI no. 62732981
  misc_feature (1)..(377): Utility: Useful for increasing seed/fruit yield or modifying fruit content
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making plants with increased biomass
  misc_feature (1)..(377): Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELEAAKSSSSVEKSYELPDGQVITIGAERFRCPEVLFQPSFIGMEAPGIHETTYNSIMKCDVDIRKDLYGNIVLSGGSTMFPGIADRMSKEITALAPSSMKIKVVAPPERKYSVWIGGSILASLSTFQQMWISKGEYDESGPAIVHRKCF

SEQ ID NO: 6863 - protein, 377 aa, Zea mays
  misc_feature (1)..(377): useful for making plants with modified plant phenotypes as described in USSN 12/139,269
  misc_feature (1)..(377): Public GI no. 9965319
  misc_feature (1)..(377): Utility: Useful for increasing seed/fruit yield or modifying fruit content
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making plants with increased biomass
  misc_feature (1)..(377): Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETAKTSSSVEKSYELPDGQVITIGAERFRCPEVLFQPSFIGMESPGIHETTYNSIMKCDVDIRKDLYGNIVLSGGSTMFPGIADRMSKEITALAPSSMKIKVVAPPERKYSVWIGGSILASLSTFQQMWISKGEYDESGPAIVHRKCF

SEQ ID NO: 6864 - protein, 377 aa, Zea mays
  misc_feature (1)..(377): useful for making plants with modified plant phenotypes as described in USSN 12/139,269
  misc_feature (1)..(377): Public GI no. 15076949
  misc_feature (1)..(377): Utility: Useful for increasing seed/fruit yield or modifying fruit content
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making plants with increased biomass
  misc_feature (1)..(377): Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDALMKILTERGYSFTTTAEREIVRDIKEKLAYVALDYEQELENAKSSSSVEKSYELPDGQVITIGAERFRCPEVLFQPSLIGMEAAGIHETTYNSIMKCDVDIRKDLYGNIVLSGGTTMFPGIADRMSKEITALAPSSMKIKVVAPPERKYSVWIGGSILASLSTFQQMWISKGEYEESGPSIVHRKCF

SEQ ID NO: 6865 - protein, 377 aa, Zea mays
  misc_feature (1)..(377): useful for making plants with modified plant phenotypes as described in USSN 12/139,269
  misc_feature (1)..(377): Public GI no. 52353611
  misc_feature (1)..(377): Utility: Useful for increasing seed/fruit yield or modifying fruit content
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making plants with increased biomass
  misc_feature (1)..(377): Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALDYEQELETAKNSSSVEKSYELPDGQVITIGAERFRCPEVLFQPSMIGMEAAGIHETTYNSIMKCDVDIRKDLYGNIVLSGGTTMFPGIADRMSKEITALAPSSMKIKVVAPPERKYSVWIGGSILASLSTFQQMWISKDEYDESGPAIVHRKCF

SEQ ID NO: 6866 - protein, 377 aa, Arabidopsis thaliana
  misc_feature (1)..(377): useful for making plants with modified plant phenotypes as described in USSN 12/139,269
  misc_feature (1)..(377): Ceres CLONE ID no. 122726
  misc_feature (1)..(377): Utility: Useful for increasing seed/fruit yield or modifying fruit content
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making plants with increased biomass
  misc_feature (1)..(377): Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDIKEKLAYVALDYEQELETAKSSSSVEKNYELPDGQVITIGAERFRCPEVLFQPSLIGMEAPGIHETTYNSIMKCDVDIRKDLYGNIVLSGGSTMFPGIADRMSKEITALAPSSMKIKVVAPPERKYSVWIGGSILASLSTFQQMWISKSEYDESGPSIVHRKCF

SEQ ID NO: 6867 - protein, 377 aa, Arabidopsis thaliana
  misc_feature (1)..(377): useful for making plants with modified plant phenotypes as described in USSN 12/139,269
  misc_feature (1)..(377): Public GI no. 24496452
  misc_feature (1)..(377): Utility: Useful for increasing seed/fruit yield or modifying fruit content
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making plants with increased biomass
  misc_feature (1)..(377): Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALDYEQELETAKNSSSVEKSYELPDGQVITIGAERFRCPEVLFQPSMIGMESSGIHETTYNSIMKCDVDIRKDLYGNIVLSGGTTMFPGIADRMSKEITALAPSSMKIKVVAPPERKYSVWIGGSILASLSTFQQMWISKDEYDESGPAIVHRKCF

SEQ ID NO: 6868 - protein, 377 aa, Arabidopsis thaliana; identical to SEQ ID NO: 6866
  misc_feature (1)..(377): useful for making plants with modified plant phenotypes as described in USSN 12/139,269
  misc_feature (1)..(377): Public GI no. 20465865
  misc_feature (1)..(377): Utility: Useful for increasing seed/fruit yield or modifying fruit content
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making plants with increased biomass
  misc_feature (1)..(377): Utility: Useful for making smaller plants

SEQ ID NO: 6869 - protein, 377 aa, Arabidopsis thaliana
  misc_feature (1)..(377): useful for making plants with modified plant phenotypes as described in USSN 12/139,269
  misc_feature (1)..(377): Public GI no. 32186890
  misc_feature (1)..(377): Utility: Useful for increasing seed/fruit yield or modifying fruit content
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making plants with increased biomass
  misc_feature (1)..(377): Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDALMKILTERGYMFTTTAEREIVRDMKEKLAYVALDYEQELETAKSSSSVEKNYELPDGQVITIGAERFRCPEVLFQPSFIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 6870 - protein, 377 aa, Zea mays
  misc_feature (1)..(377): useful for making plants with modified plant phenotypes as described in USSN 12/139,269
  misc_feature (1)..(377): Ceres CLONE ID no. 230603
  misc_feature (1)..(377): Utility: Useful for increasing seed/fruit yield or modifying fruit content
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making plants with increased biomass
  misc_feature (1)..(377): Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYIALDYEQELETAKNSSSVEKSYELPDGQVITIGAERFRCPEVLFQPSMIGMEAAGIHETTYNSIMKCDVDIRKDLYGNIVLSGGSTMFPGIADRMSKEITSLAPSSMKIKVVAPPERKYSVWIGGSILASLSTFQQMWISKEEYDESGPAIVHRKCF

SEQ ID NO: 6871 - protein, 377 aa, Zea mays; identical to SEQ ID NO: 6870
  misc_feature (1)..(377): useful for making plants with modified plant phenotypes as described in USSN 12/139,269
  misc_feature (1)..(377): Public GI no. 53759189
  misc_feature (1)..(377): Utility: Useful for increasing seed/fruit yield or modifying fruit content
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making plants with increased biomass
  misc_feature (1)..(377): Utility: Useful for making smaller plants

SEQ ID NO: 6872 - protein, 377 aa, Zea mays; identical to SEQ ID NO: 6870
  misc_feature (1)..(377): useful for making plants with modified plant phenotypes as described in USSN 12/139,269
  misc_feature (1)..(377): Ceres CLONE ID no. 219282
  misc_feature (1)..(377): Utility: Useful for increasing seed/fruit yield or modifying fruit content
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making plants with increased biomass
  misc_feature (1)..(377): Utility: Useful for making smaller plants

SEQ ID NO: 6873 - protein, 377 aa, Zea mays; identical to SEQ ID NO: 6870
  misc_feature (1)..(377): useful for making plants with modified plant phenotypes as described in USSN 12/139,269
  misc_feature (1)..(377): Ceres CLONE ID no. 331439
  misc_feature (1)..(377): Utility: Useful for increasing seed/fruit yield or modifying fruit content
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making plants with increased biomass
  misc_feature (1)..(377): Utility: Useful for making smaller plants

SEQ ID NO: 6874 - protein, 377 aa, Zea mays
  misc_feature (1)..(377): useful for making plants with modified plant phenotypes as described in USSN 12/139,269
  misc_feature (1)..(377): Public GI no. 50919951
  misc_feature (1)..(377): Utility: Useful for increasing seed/fruit yield or modifying fruit content
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making plants with increased biomass
  misc_feature (1)..(377): Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPILLTEAPLNPKANREKMTQIMFETFNAPAMYVAIQAVLSLYASGRTTGIVLDSGDGVTHTVPIYEGYALPHAILRLDLAGRDLTDCLMKILTERGYSFTTTAEREIVRDIKEKLAYIALDYEQELETAKSSSSVEKSYELPDGQVITIGAERFRCPEVLFQPSLIGMEAPGIHETTYNSIMKCDVDIRKDLYGNIVLSGGTTMFPGIADRMSKEITALAPSSMKIKVVAPPERKYSVWIGGSILASLSTFQQMWISKGEYDESGPSIVHRKCF

SEQ ID NO: 6875 - protein, 377 aa, Zea mays
  misc_feature (1)..(377): useful for making plants with modified plant phenotypes as described in USSN 12/139,269
  misc_feature (1)..(377): Ceres CLONE ID no. 338602
  misc_feature (1)..(377): Utility: Useful for increasing seed/fruit yield or modifying fruit content
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making plants with increased biomass
  misc_feature (1)..(377): Utility: Useful for making smaller plants
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDMKEKLAYIALDYDQEMETAKTSSSVEKSYELPDGQVITIGAERFRCPEVLFQPSFIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 6876 - protein, 377 aa, Zea mays; identical to SEQ ID NO: 6875
  misc_feature (1)..(377): useful for making plants with modified plant phenotypes as described in USSN 12/139,269
  misc_feature (1)..(377): Ceres CLONE ID no. 299306
  misc_feature (1)..(377): Utility: Useful for increasing seed/fruit yield or modifying fruit content
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making plants with increased biomass
  misc_feature (1)..(377): Utility: Useful for making smaller plants

SEQ ID NO: 6877 - DNA, 614 bp, Arabidopsis thaliana; identical to SEQ ID NO: 5242
  misc_feature (1)..(614): useful for making plants with modified plant phenotypes as described in USSN 12/139,269
  misc_feature (1)..(614): Ceres CLONE ID no. 1952
  misc_feature (1)..(614): Also known as  Ceres CDNA ID no. 23388951

SEQ ID NO: 6878 - protein, 296 aa, Arabidopsis thaliana
  misc_feature (1)..(296): useful for making plants with modified plant phenotypes as described in USSN 12/139,269
  misc_feature (1)..(296): Utility: Useful for making larger plants
  misc_feature (1)..(296): Utility: Useful for making ornamental plants with modified flowers
  misc_feature (1)..(296): Utility: Useful for making ornamental plants with modified leaves
  misc_feature (1)..(296): Utility: Useful for making plants with enhanced plant architecture
  misc_feature (1)..(296): Utility: Useful for making plants with increased biomass
  misc_feature (1)..(296): Utility: Useful for making plants with increased biomass and foliage
  misc_feature (1)..(296): Utility: Useful for making plants with modified flowers
  misc_feature (1)..(296): Utility: Useful for making shorter plants and plants with modified flowers
  misc_feature (1)..(296): Utility: Useful for making smaller plants
  misc_feature (139)..(139): Xaa is any aa, unknown or other
PRVKKVCLEVKEVCLVVEEVNPKVKKVNSKLNWERKKVCPEACQEVKKVCLEVKEVCPVVEEVNPKVKKVNSKLNWERKKVCPEACQEVKKVCLEVKEVCPEVEEVNPKVEKVNSKLNWERKNVCTEACQEVKEVCLEXKEVYPEVVCLGAVEVNTKLEEVNTEVLEVNSERKEACPEVEEACQEVKEVCLEVKEVCPEVVCLGVAEVNTKLEEVNTEVLEVNSERKEVCQEVKEVCLEVKEVCRKVVCPGVEGVNTKSEEVNTNLEEVNTEVEVATWRSKEQWSSCSNIKQIIVH

SEQ ID NO: 6879 - DNA, 1539 bp, Arabidopsis thaliana
  misc_feature (1)..(1539): useful for making plants with modified plant phenotypes as described in USSN 12/139,269
  misc_feature (1)..(1539): Ceres CLONE ID no. 4289
  misc_feature (1)..(1539): Also known as  Ceres CDNA ID no. 23380466
  misc_feature (1049)..(1049): m is a or c
  misc_feature (1077)..(1077): w is a or t/u
  misc_feature (1089)..(1089): y is t/u or c
  misc_feature (1148)..(1148): k is g or t/u
  misc_feature (1149)..(1149): k is g or t/u
  misc_feature (1150)..(1150): w is a or t/u
  misc_feature (1151)..(1151): w is a or t/u
aggttcacttctttgatcttccattactaaatgttctctcctctttctctctttttgtaatttctctcttaaattcttcattgatgttttgattcgttttagtaagaattttgattcatttccaaaagatattcctattcccatcttcttttctaatccgctttctttaatattccaacatctatatatatgcctacgaattcgaatcatcagcatcatcttcaacaccagcttaacgaaaatggaagtataataagtggccacggactagtactctctcaccaacttccacctctccaagcaaaccctaaccctaaccaccaccatgtcgctacctctgctggtcttccagtcaaggatgggtggatcgatggcggagagagcaaggcaggccaacattcctccactagcgggacccctaaagtgtcctcgatgcgactccagcaacactaagttctgttactacaacaactataacctcactcagcctcgttacttctgcaaaggttgccgtcgctactggacacaagggggcgccctgagaaacgtccctgtaggtggaggctgccggaggaataacaagaagggcaaaaatggaaatttaaaatcttcttcttcttcgtccaaacagtcttcctcggtcaacgctcaaagtcctagctcaggacagctaaggacaaatcatcagttccctttttcaccaactctttacaatctcactcaactcggaggtattggtttgaacttagccgctactaatggcaacaaccaagctcaccagatcggttccagtttgatgatgagcgatctagggtttctccatggacgaaatacttcaactccgatgacgggaaacattcatgaaaacaacaacaataataacaatgaaaacaacctaatggcatccgttggatctttgagcccctttgctctcttcgatccaacgacggggctatacgctttccagaacgacggtaatatcgggaacaacgttgggatatctggttcttctacttccatggttgattctagggtttatcagacgcctmcggtgaagatggaagaacaacctaattwggctaacttgtytagaccggtctccggtttgacgtctcctgggaatcaaacaaatcaatacttttggcctkkwwcggatttctcgggtccttctaatgatatcttgtgagatttttgtgtgttttgtcggatcattaacgtatgttacgacttacgacgtggagattgattaaaaggactaccaacggtcaggattaactgcatgcatagtctgtgctcaagacgatgatcgtggagaagtacaaggacaaactaaaaggtatcttaattagagattgtggttttacaacttaaattcgatacttatttatataatcaggtgtgtcatataatttgtttgtattgcgtgatttcatggttgatctgatttctcaagttgctatatatgcctcaatacatgtgtgtaacagtccaatttgtatactctttagactgaattttatcgaatatataatatttttc

SEQ ID NO: 6880 - protein, 331 aa, Arabidopsis thaliana
  misc_feature (1)..(331): useful for making plants with modified plant phenotypes as described in USSN 12/139,269
  misc_feature (72)..(134): Pfam Name: zf-Dof; Pfam Description: Dof domain, zinc finger
  misc_feature (72)..(134): Pfam Name: zf-Dof; Pfam Description: Dof domain, zinc finger
  misc_feature (1)..(331): Utility: Useful for making larger plants
  misc_feature (1)..(331): Utility: Useful for making plants sterile and for genetic confinement
  misc_feature (1)..(331): Utility: Useful for making smaller plants
MPTNSNHQHHLQHQLNENGSIISGHGLVLSHQLPPLQANPNPNHHHVATSAGLPSRMGGSMAERARQANIPPLAGPLKCPRCDSSNTKFCYYNNYNLTQPRYFCKGCRRYWTQGGALRNVPVGGGCRRNNKKGKNGNLKSSSSSSKQSSSVNAQSPSSGQLRTNHQFPFSPTLYNLTQLGGIGLNLAATNGNNQAHQIGSSLMMSDLGFLHGRNTSTPMTGNIHENNNNNNNENNLMASVGSLSPFALFDPTTGLYAFQNDGNIGNNVGISGSSTSMVDSRVYQTPPVKMEEQPNLANLSRPVSGLTSPGNQTNQYFWPGSDFSGPSNDIL

SEQ ID NO: 6881 - protein, 320 aa, Arabidopsis thaliana
  misc_feature (1)..(320): useful for making plants with modified plant phenotypes as described in USSN 12/139,269
  misc_feature (1)..(320): Public GI no. 3927829
  misc_feature (1)..(320): Utility: Useful for making larger plants
  misc_feature (1)..(320): Utility: Useful for making plants sterile and for genetic confinement
  misc_feature (1)..(320): Utility: Useful for making smaller plants
MVFSSVSSFLDPPINWPQSANPNNHPHHHQLQENGSLVSGHHQVLSHHFPQNPNPNHHHVETAAATTVDPSSLNGQAAERARLAKNSQPPEGALKCPRCDSANTKFCYFNNYNLTQPRHFCKACRRYWTRGGALRNVPVGGGCRRNKKGKSGNSKSSSSSQNKQSTSMVNATSPTNTSNVQLQTNSQFPFLPTLQNLTQLGGIGLNLAAINGNNGGNGPVMGNNNENNLMTSLGSSSHFALFDRTMGLYNFPNEVNMGLSSIGATRVSQTAQVKMEDNHLGNISRPVSGLTSPGNQSNQYWTGQGLPGSSSNDHHHQHLM

SEQ ID NO: 6882 - protein, 340 aa, Arabidopsis thaliana
  misc_feature (1)..(340): useful for making plants with modified plant phenotypes as described in USSN 12/139,269
  misc_feature (1)..(340): Public GI no. 30684022
  misc_feature (1)..(340): Utility: Useful for making larger plants
  misc_feature (1)..(340): Utility: Useful for making plants sterile and for genetic confinement
  misc_feature (1)..(340): Utility: Useful for making smaller plants
MVFSSVSSFLDPPINWPQSANPNNHPHHHQLQENGSLVSGHHQVLSHHFPQNPNPNHHHVETAAATTVDPSSLNGQAAERARLAKNSQPPEGALKCPRCDSANTKFCYFNNYNLTQPRHFCKACRRYWTRGGALRNVPVGGGCRRNKKGKSGNSKSSSSSQNKQSTSMVNATSPTNTSNVQLQTNSQFPFLPTLQNLTQLGGIGLNLAAINGNNGGNGNTSSSFLNDLGFFHGGNTSGPVMGNNNENNLMTSLGSSSHFALFDRTMGLYNFPNEVNMGLSSIGATRVSQTAQVKMEDNHLGNISRPVSGLTSPGNQSNQYWTGQGLPGSSSNDHHHQHLM

SEQ ID NO: 6883 - DNA, 1873 bp, Arabidopsis thaliana
  misc_feature (1)..(1873): useful for making plants with modified plant phenotypes as described in USSN 12/139,269
  misc_feature (1)..(1873): Ceres CLONE ID no. 7925
  misc_feature (1)..(1873): Also known as  Ceres CDNA ID no. 23376949
agaacactcttgtcacacttccatttagggttttctgcaaatttctccgttcgagatcaattccgtcgagatctcaagctctctcactcgtagtaaaaaaatggcggcggtagcggcaccgatagcttcgaagccccgcggatctaaagctgaatcgttcgtagacaacaagcggagagaagatatccgattcgcgaacatcaactctgctcgagccgtctctgacgccgtccgtactagtttgggaccgaaaggaatggacaagatgatttccacggcgaacggagaggtaatcattactaacgatggagctacgatccttaacaagatggaggttttgcagccagcggcgaagatgttggtcgaactttccaaatcacaagattcagccgccggagatggtactacaaccgtcgtagtaatcgccggtgcgcttctcaaggagtgtcaatcgcttctcacaaacgggatccaccctactgtcatttcagattcgcttcacaaagcgtgtggtaaggcgatcgatattttgactgccatggctgttccagtggagctcactgatagagattcacttgtgaaatctgcgagcacatcgcttaacagtaaggttgttagtcagtactctacattgcttgctcctttagctgtagatgcggttctctctgttatagatccggaaaagcctgagattgtggatttgcgtgatattaagattgttaagaagcttggtgggactgtggatgatacacatactgtgaaaggtttggtttttgataagaaggttagccgtgctgctggtggaccgactcgtgtggagaatgctaagattgctgtgattcagttccagatctcacctcctaagactgatatcgagcagagtattgttgtctctgattatactcagatggataggatcttgaaagaagagaggaattacatattggggatgattaagaagatcaaagcaactggttgcaatgtgttgttgattcagaagagtattttgagggatgcagtgactgatctatctcttcactatttggccaaagctaagattatggttattaaggatgttgagagagatgagattgaatttgtcaccaagacattgaactgcttgcctatcgccaatattgagcatttcagagctgagaagcttggccatgctgatcttgttgaggaggcctcccttggagatggaaagattttgaagatcactggtatcaaggacatggggagaactacatctgttctagttcgtggctccaaccagcttgttctagatgaagctgaaaggagtttacatgatgccttgtgtgtggttaggtgtctagtgagcaaaaggttcttgattgcaggaggtggtgcaccagagattgagctctcaaggcagctcggtgcttgggctaaggtgctacatgggatggaaggttactgtgtgaagtcttttgctgaagctctcgaagttattccttacacactagccgagaatgcagggttaaaccctatcgccattgtgactgaactcaggaacaagcatgctcaaggggaaatcaacgcagggatcaatgtgaggaaaggacagatcactaacatcttggaggaaaatgttgttcagcccctgcttgtgagtaccagtgcgatcactttagcaactgaatgcgttaggatgattttgaagattgatgacatcgtaactgtgaggtagtgtggtagtttctttcaaaacaggtcccagaacacttctattgctctatctaagcttttgtttcgtttttttcatgtgttgtgcttgcacaatggttttgaacttagactcccttttcttgcaacatgtgctattgcagttaagtggctttatttgtggttt

SEQ ID NO: 6884 - protein, 536 aa, Arabidopsis thaliana
  misc_feature (1)..(536): useful for making plants with modified plant phenotypes as described in USSN 12/139,269
  misc_feature (40)..(536): Pfam Name: Cpn60_TCP1; Pfam Description: TCP-1/cpn60 chaperonin family
  misc_feature (1)..(536): Utility: Useful for making larger plants
MAAVAAPIASKPRGSKAESFVDNKRREDIRFANINSARAVSDAVRTSLGPKGMDKMISTANGEVIITNDGATILNKMEVLQPAAKMLVELSKSQDSAAGDGTTTVVVIAGALLKECQSLLTNGIHPTVISDSLHKACGKAIDILTAMAVPVELTDRDSLVKSASTSLNSKVVSQYSTLLAPLAVDAVLSVIDPEKPEIVDLRDIKIVKKLGGTVDDTHTVKGLVFDKKVSRAAGGPTRVENAKIAVIQFQISPPKTDIEQSIVVSDYTQMDRILKEERNYILGMIKKIKATGCNVLLIQKSILRDAVTDLSLHYLAKAKIMVIKDVERDEIEFVTKTLNCLPIANIEHFRAEKLGHADLVEEASLGDGKILKITGIKDMGRTTSVLVRGSNQLVLDEAERSLHDALCVVRCLVSKRFLIAGGGAPEIELSRQLGAWAKVLHGMEGYCVKSFAEALEVIPYTLAENAGLNPIAIVTELRNKHAQGEINAGINVRKGQITNILEENVVQPLLVSTSAITLATECVRMILKIDDIVTVR

SEQ ID NO: 6885 - protein, 407 aa, Zea mays
  misc_feature (1)..(407): useful for making plants with modified plant phenotypes as described in USSN 12/139,269
  misc_feature (1)..(407): Ceres CLONE ID no. 326385
  misc_feature (1)..(407): Utility: Useful for making larger plants
MAAAVAAPAPSRKTETYTDTKRRDDVRGANIAAARAVADAVRTSLGPRGMDKMIASGDQAQEVIITNDGATILSRMALLQPAARMLAELSRSQDAAAGDGTTTVVVLAGSLLRRAQSLLSAGAHPTAAADALHRLATRAVEILHAMAIPIELSDRESLVKSASTALNSKVVSQYSTLLSPLAVDAALSVVDPAHPDLLDLRDIRIVKKLGGTVDDTELIPGLIFDKKASHAAGGPTRMENAKIAVIQFQISPPKTDIEQSVIVSDYAQMDRILREERNYILGMVKKIKAAGCNVLLIQKSILRDAVTDLSLHYLAKAKILVVKDVERDEMEFITKTLNCLPIANIEHFRTDKFGYADVVEEVSVGEGKVVKITGIKDMVGPQLYLSGDLTNWLLMKLNAVSMMHSVS

SEQ ID NO: 6886 - DNA, 729 bp, Arabidopsis thaliana
  misc_feature (1)..(729): useful for making plants with modified plant phenotypes as described in USSN 12/139,269
  misc_feature (1)..(729): Ceres CLONE ID no. 10857
  misc_feature (1)..(729): Also known as  Ceres CDNA ID no. 23372044
aagttgaggcatcgtcatcgtgaaatgtgcagctccggaaataaataatcactaaaataaccagatccgatctactgccccggtttctcgccggaatctccattctgtaaccggcgatcctctttctgttatggaagacgtgaaagggaaggagattattgatgatgctcctattgacaacaaggtttcagatgaaatggagagtgaggaaaatgcgatcaagaaaaagtatggaggattgttgcctaagaagattcctttgatatctaaggaccatgaacgtgcgttttttgactcagctgattgggctttaggcaagcaaaaaggacagaagccgaaagggcctttggaagctctccgcccaaaactgcagccaaccccgcaacagcaaccaagagcaagacgaatggcttattcttcaggcgaaactgaagacactgagattgataacaacgaagctccggatgaccaagcctgcgcatcagctgtggatagtaccaatttaaaggacgatggaggcgcaaaagacaacatcaaatcatgaacaacatatagagatctcttgaggagcgcaaacaaacaacatcacaagtcaatttacagaagaataagcgaccaggtttgctttgcaacggttgtaatatcaagtctcttaccttatcatacttgggactgcaaatctgtatcacttacaaacctcctggcttgaaacgtctattggacgattgt

SEQ ID NO: 6887 - protein, 137 aa, Arabidopsis thaliana
  misc_feature (1)..(137): useful for making plants with modified plant phenotypes as described in USSN 12/139,269
  misc_feature (31)..(125): Pfam Name: Lg106; Pfam Description: Lg106-like protein
  misc_feature (1)..(137): Utility: Useful for making larger plants
  misc_feature (1)..(137): Utility: Useful for making plants sterile and for genetic confinement
  misc_feature (1)..(137): Utility: Useful for making smaller plants
MEDVKGKEIIDDAPIDNKVSDEMESEENAIKKKYGGLLPKKIPLISKDHERAFFDSADWALGKQKGQKPKGPLEALRPKLQPTPQQQPRARRMAYSSGETEDTEIDNNEAPDDQACASAVDSTNLKDDGGAKDNIKS

SEQ ID NO: 6888 - protein, 116 aa, Arabidopsis thaliana
  misc_feature (1)..(116): useful for making plants with modified plant phenotypes as described in USSN 12/139,269
  misc_feature (1)..(116): Ceres CLONE ID no. 1334970
  misc_feature (1)..(116): Utility: Useful for making larger plants
  misc_feature (1)..(116): Utility: Useful for making plants sterile and for genetic confinement
  misc_feature (1)..(116): Utility: Useful for making smaller plants
  misc_feature (87)..(87): Xaa is any aa, unknown or other
  misc_feature (88)..(88): Xaa is any aa, unknown or other
  misc_feature (89)..(89): Xaa is any aa, unknown or other
  misc_feature (94)..(94): Xaa is any aa, unknown or other
  misc_feature (95)..(95): Xaa is any aa, unknown or other
MESEENAIKKKYGGLLPKKIPLISEDHERAFFDSADWALGKQKGQKPKGPLEALRPKLQPTPQQQPRARRMAYSSGETEDSETDNTXXXGRTRXXASVVDSTNLKDDGGAKDNIKS

SEQ ID NO: 6889 - protein, 160 aa, Glycine max
  misc_feature (1)..(160): useful for making plants with modified plant phenotypes as described in USSN 12/139,269
  misc_feature (1)..(160): Ceres CLONE ID no. 648816
  misc_feature (1)..(160): Utility: Useful for making larger plants
  misc_feature (1)..(160): Utility: Useful for making plants sterile and for genetic confinement
  misc_feature (1)..(160): Utility: Useful for making smaller plants
MSDAKVEDLKKEEEVGDDSPRNEVDSEKSADDLKDSDNDKSDGNPMPSSQQEEAAVKKKYGGMLPKKPPLISKDHERAYFDSTDWALGKQGAQKPKGPLEALRPKLQPTQQHARSRRSAYAPADDNEVDGCNSDASAEHQSATEEVGGDKSDTAQDQSCH

SEQ ID NO: 6890 - protein, 123 aa, Triticum aestivum
  misc_feature (1)..(123): useful for making plants with modified plant phenotypes as described in USSN 12/139,269
  misc_feature (1)..(123): Ceres CLONE ID no. 617857
  misc_feature (1)..(123): Utility: Useful for making larger plants
  misc_feature (1)..(123): Utility: Useful for making plants sterile and for genetic confinement
  misc_feature (1)..(123): Utility: Useful for making smaller plants
MKDANAAGHDNVGNSEPMDQSGDNAMPSAQQQEQVIKKKFGGLIPKKPPLISKDHERAYFDSADWALGKSGQQGVAKPKGPLEALRPKLQPTRQQQQRSRSSIYSSSENEDGDGAGSEDMNIN

SEQ ID NO: 6891 - protein, 104 aa, Zea mays
  misc_feature (1)..(104): useful for making plants with modified plant phenotypes as described in USSN 12/139,269
  misc_feature (1)..(104): Ceres CLONE ID no. 399368
  misc_feature (1)..(104): Utility: Useful for making larger plants
  misc_feature (1)..(104): Utility: Useful for making plants sterile and for genetic confinement
  misc_feature (1)..(104): Utility: Useful for making smaller plants
MDQTEDNSMPSAQQQEEAIKKKFGGLMPKKPPLISKDHERAYFDSADWALGKQGVAKPKGPLEALRPKLQPTRQQQQQRARRPIYTSSENEDGDGAGAEDMNIN

SEQ ID NO: 6892 - DNA, 807 bp, Arabidopsis thaliana
  misc_feature (1)..(807): useful for making plants with modified plant phenotypes as described in USSN 12/139,269
  misc_feature (1)..(807): Ceres CLONE ID no. 19481
  misc_feature (1)..(807): Also known as  Ceres CDNA ID no. 23366921
cacacatacatcttctccatccattacacaacgaagcatagtggcaaacccgtaaatacataataccaatgacgaccaaagattgcggaaaccacggcggcggcggaggaggaggaaccgccagtcgaatctgcggagtaatcatcggcttcatcatcatcgtcttgataacaatattcctcgtttggataatcctccaaccgacaaaaccaagattcatcctccaagacgccaccgtctacgcctttaatctctcgcagcctaacctcctcacctcaaactttcagatcacgatcgcttcacgtaaccgaaactcaagaatcggaatctactacgaccgtcttcacgtctacgctacttaccggaaccaacaaatcactctacgtacagcaattcctccgacgtaccaaggccataaagaagacaacgtttggtctcctttcgtttatggaaactccgtccctatcgctcctttcaacgccgtggctctcggcgacgagcagaatcgtgggtttgtcacgttgattatacgcgccgatggacgcgtgaggtggaaggtcgggactcttattacagggaagtatcatctccatgttcgttgtcaggcgttcataaatctggctgataaagccgccggagttcatgtcggcgaaaacgccgtcaagtacatgttgatcaataagtgcagtgtcaatgtttagtaggtaaaatgacacaactttgacgccgtcaatgtttgcattcttcttcttttcatttttcttctacttggataatgtttttgcttcaatatcgtttaatttgtcc

SEQ ID NO: 6893 - protein, 210 aa, Arabidopsis thaliana
  misc_feature (1)..(210): useful for making plants with modified plant phenotypes as described in USSN 12/139,269
  misc_feature (40)..(178): Pfam Name: Hin1; Pfam Description: Harpin-induced protein 1 (Hin1)
  misc_feature (1)..(210): Utility: Useful for making larger plants
  misc_feature (1)..(210): Utility: Useful for making ornamental plants with modified leaves
  misc_feature (1)..(210): Utility: Useful for making plants sterile and for genetic confinement
  misc_feature (1)..(210): Utility: Useful for making plants with increased biomass and foliage
MTTKDCGNHGGGGGGGTASRICGVIIGFIIIVLITIFLVWIILQPTKPRFILQDATVYAFNLSQPNLLTSNFQITIASRNRNSRIGIYYDRLHVYATYRNQQITLRTAIPPTYQGHKEDNVWSPFVYGNSVPIAPFNAVALGDEQNRGFVTLIIRADGRVRWKVGTLITGKYHLHVRCQAFINLADKAAGVHVGENAVKYMLINKCSVNV

SEQ ID NO: 6894 - protein, 187 aa, Zea mays
  misc_feature (1)..(187): useful for making plants with modified plant phenotypes as described in USSN 12/139,269
  misc_feature (1)..(187): Ceres CLONE ID no. 342958
  misc_feature (1)..(187): Utility: Useful for making larger plants
  misc_feature (1)..(187): Utility: Useful for making ornamental plants with modified leaves
  misc_feature (1)..(187): Utility: Useful for making plants sterile and for genetic confinement
  misc_feature (1)..(187): Utility: Useful for making plants with increased biomass and foliage
MALLVGVVALIVYLVLRPTHPRFYLQDAALRQLDLSNGSAPLLSTAAQVTVASRNPNGRVGVYYDRLDVYATYKYQQVTLASRLPAVYQGHGDVDVWSPVLAGPAVPFAPFLADALAKDLAAGYLVLQLRIDGRVRWKVGSWVSGHYHMFVTCPAYFISSGAGSGYRGAVGAHGLRFQTTTYCRVEV

SEQ ID NO: 6895 - protein, 213 aa, Triticum aestivum
  misc_feature (1)..(213): useful for making plants with modified plant phenotypes as described in USSN 12/139,269
  misc_feature (1)..(213): Ceres CLONE ID no. 632710
  misc_feature (1)..(213): Utility: Useful for making larger plants
  misc_feature (1)..(213): Utility: Useful for making ornamental plants with modified leaves
  misc_feature (1)..(213): Utility: Useful for making plants sterile and for genetic confinement
  misc_feature (1)..(213): Utility: Useful for making plants with increased biomass and foliage
MSKDCGNHGEDDIRRTCRRFLAFLFFLALVVAVIALIVYLVLRPTHPRFYLQDASLRQLDVLTANASAAAGVLSTVLQVTVASRNPNDRVGVYYDRLDVYASYKYQQITLASALPPVYQGHGDVEVWSPVLSGPNVPFAPYLADALAKDVQAGYLILQVKIDGRVRWKVGSWISGHYHIFVTCPAFLIGTGGNGAPGANGLRFQTATYCHVEV

SEQ ID NO: 6896 - protein, 213 aa, Zea mays
  misc_feature (1)..(213): useful for making plants with modified plant phenotypes as described in USSN 12/139,269
  misc_feature (1)..(213): Ceres CLONE ID no. 443426
  misc_feature (1)..(213): Utility: Useful for making larger plants
  misc_feature (1)..(213): Utility: Useful for making ornamental plants with modified leaves
  misc_feature (1)..(213): Utility: Useful for making plants sterile and for genetic confinement
  misc_feature (1)..(213): Utility: Useful for making plants with increased biomass and foliage
MGKDCGNHGDDDFRQSCRRLLAILLTMALLVGVVALIVYLVLRPTHPRFYLQDAALRQLDLSNGSAPLLSTAAQVTVASRNPNGRVGVYYDRLDVYATYKYQQVTLASRLPTVYQGHGDVDVWSPVLAGPAVPFAPFLADALAKDLAAGYLVLQLRIDGRVRWKVGSWVSGHYHMFVTCPAYFISSGAGSGYRGAVGAHGLRFQTTTYCRVEV

SEQ ID NO: 6897 - protein, 221 aa, Triticum aestivum
  misc_feature (1)..(221): useful for making plants with modified plant phenotypes as described in USSN 12/139,269
  misc_feature (1)..(221): Ceres CLONE ID no. 699425
  misc_feature (1)..(221): Utility: Useful for making larger plants
  misc_feature (1)..(221): Utility: Useful for making ornamental plants with modified leaves
  misc_feature (1)..(221): Utility: Useful for making plants sterile and for genetic confinement
  misc_feature (1)..(221): Utility: Useful for making plants with increased biomass and foliage
MAVKDCGGHKGGGCECHRRRLYRKCCGALLALVLLALFIILIVYLVLRPHKPRFYLQDLAVLCLNVTPPTSAYLFTTMQATVAARNPNDRVGVYYDEADMYAQYKGVAITVPTRLPVAYQGHRDQSVWSPYLRSMDSVVLPPQLAVALAQDETAGYVLVDVRVDGQVRWKVGTWISGHYHLRVNCPALIRVNEGKGSYGATTGGGPDYFRFQQAAACAVDV

SEQ ID NO: 6898 - protein, 188 aa, Zea mays
  misc_feature (1)..(188): useful for making plants with modified plant phenotypes as described in USSN 12/139,269
  misc_feature (1)..(188): Ceres CLONE ID no. 1279273
  misc_feature (1)..(188): Utility: Useful for making larger plants
  misc_feature (1)..(188): Utility: Useful for making ornamental plants with modified leaves
  misc_feature (1)..(188): Utility: Useful for making plants sterile and for genetic confinement
  misc_feature (1)..(188): Utility: Useful for making plants with increased biomass and foliage
MASCLLALVLIVAFVSLVVYLALRPSKPSFYLQDLQLRRPISLGDPSLTASAQVTLAARNPNDRVGIFYKRLDVFVTYRDEAVTVPVSLPPQYQGHRDFTVWSPVLSAESVPVAAYVADAMKQDVAAGFVALQVKVDGRVKWKVGSWVSGSYHLFVSCPAVLSAGYPGVNNTVSSLKFAQPTGCSVEV

SEQ ID NO: 6899 - DNA, 586 bp, Arabidopsis thaliana
  misc_feature (1)..(586): useful for making plants with modified plant phenotypes as described in USSN 12/139,269
  misc_feature (1)..(586): Ceres CLONE ID no. 28979
  misc_feature (1)..(586): Also known as  Ceres CDNA ID no. 23381298
ttgcctaaatcattttaaagactgtatagaggaaaacaaaactgcaaaaacaaaaataaaaaaaacatcgcacaagaaaataaaagatttgtagaatcaactaagaaaatggctagcactatgatgactacattgcctcagttcaatggtcttcgagccaccaaaatctctgcagctcctgtacaaggcctggcaagtgttcagcccatgagacgcaagggaaatggagctttgggtgcaaagtgtgacttcatcggttcatcaacaaatctgataatggtaacgtcgacgaccctgatgttgttcgcggggagattcggacttgcgccatcagccaataggaaggcgacagctggacttaggttggaggcacgtgactcaggtctacaaacgggtgacccggccgggttcacgcttgcggacactttggcttgtggcaccgttggtcatatcatcggtgtaggagttgtccttggccttaaaaacattggtgctatttgaagttcctaaagctcttttatttgtatttgtaaaatttgtagatttttataacaatattctcatgcacctgaacgagatctaatgc

SEQ ID NO: 6900 - protein, 130 aa, Arabidopsis thaliana
  misc_feature (1)..(130): useful for making plants with modified plant phenotypes as described in USSN 12/139,269
  misc_feature (50)..(130): Pfam Name: PSI_PSAK; Pfam Description: Photosystem I psaG / psaK
  misc_feature (1)..(130): Utility: Useful for making larger plants
MASTMMTTLPQFNGLRATKISAAPVQGLASVQPMRRKGNGALGAKCDFIGSSTNLIMVTSTTLMLFAGRFGLAPSANRKATAGLRLEARDSGLQTGDPAGFTLADTLACGTVGHIIGVGVVLGLKNIGAI

SEQ ID NO: 6901 - protein, 105 aa, Brassica napus
  misc_feature (1)..(105): useful for making plants with modified plant phenotypes as described in USSN 12/139,269
  misc_feature (1)..(105): Ceres CLONE ID no. 1084062
  misc_feature (1)..(105): Utility: Useful for making larger plants
MTTLPQFNGLRASKISAAPVQGLATVVPMRRKGNGALGAKCDFIGSSTNLIMVTSTTLMLFAGRFGLAPSANRKATAGLKLEARDSGLQTGDPAGFTLADTLACG

SEQ ID NO: 6902 - protein, 79 aa, Zea mays
  misc_feature (1)..(79): useful for making plants with modified plant phenotypes as described in USSN 12/139,269
  misc_feature (1)..(79): Ceres CLONE ID no. 302875
  misc_feature (1)..(79): Utility: Useful for making larger plants
MVTTTTLMLFAGRFGLAPSANRKATAGLKLEARDSGLQTGDPAGFTLADTLACGAVGHILGVGIVLGLKNTGALDQIIG

SEQ ID NO: 6903 - protein, 79 aa, Zea mays; identical to SEQ ID NO: 6902
  misc_feature (1)..(79): useful for making plants with modified plant phenotypes as described in USSN 12/139,269
  misc_feature (1)..(79): Ceres CLONE ID no. 1347193
  misc_feature (1)..(79): Utility: Useful for making larger plants

SEQ ID NO: 6904 - protein, 125 aa, Glycine max
  misc_feature (1)..(125): useful for making plants with modified plant phenotypes as described in USSN 12/139,269
  misc_feature (1)..(125): Ceres CLONE ID no. 653284
  misc_feature (1)..(125): Utility: Useful for making larger plants
  misc_feature (14)..(14): Xaa is any aa, unknown or other
MTTLPQFSGLRPQXSAAPVKNLVAVQQPMRPKGKGALGARCDYIGSSTNLIMVASTTLMLFAGRFGLAPSANRKATAGLKLEVRDSGLQTGDPAGFTLADTLACGSVGHIIGVGVVLGLKNIGAL

SEQ ID NO: 6905 - protein, 127 aa, Parthenium argentatum
  misc_feature (1)..(127): useful for making plants with modified plant phenotypes as described in USSN 12/139,269
  misc_feature (1)..(127): Ceres CLONE ID no. 1605870
  misc_feature (1)..(127): Utility: Useful for making larger plants
MSSLPQFTGLKATSLSLSPVQNMVSLQPMKPKGKGKGALSVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 6906 - protein, 130 aa, Parthenium argentatum
  misc_feature (1)..(130): useful for making plants with modified plant phenotypes as described in USSN 12/139,269
  misc_feature (1)..(130): Ceres CLONE ID no. 1606960
  misc_feature (1)..(130): Utility: Useful for making larger plants
MASAIMSSLPQFNGLKATSPSPSPVQNMVALQPMKPKGKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 6907 - protein, 132 aa, Parthenium argentatum
  misc_feature (1)..(132): useful for making plants with modified plant phenotypes as described in USSN 12/139,269
  misc_feature (1)..(132): Ceres CLONE ID no. 1608365
  misc_feature (1)..(132): Utility: Useful for making larger plants
MATAVMSSLPQFTGLKATSSSLSPVQNMVSMQPMKPKAKGKGALGVRCDFIGSSTNLIMVTSTTLMLFAGRFGLAPSANRKATAGLKLEVRDSGLQTGDPAGFTLADTLACGTVGHIIGVGVVLGLKNIGAI

SEQ ID NO: 6908 - protein, 130 aa, Triticum aestivum
  misc_feature (1)..(130): useful for making plants with modified plant phenotypes as described in USSN 12/139,269
  misc_feature (1)..(130): Ceres CLONE ID no. 1054986
  misc_feature (1)..(130): Utility: Useful for making larger plants
MASQLSAMTSVPQFHGLRSYSSPRSIATLPSLRKRSQGIRCDYIGSSTNIIMVTTTTLMLFAGRFGLAPSANRKATAGLKLEARESGLQTGDPAGFTLADTLACGSFGHILGVGIVLGLKNTGVLDQIIG

SEQ ID NO: 6909 - DNA, 1425 bp, Arabidopsis thaliana
  misc_feature (1)..(1425): useful for making plants with modified plant phenotypes as described in USSN 12/139,269
  misc_feature (1)..(1425): Ceres CLONE ID no. 37969
  misc_feature (1)..(1425): Also known as  Ceres CDNA ID no. 23377412
aaatgttcttaaatctatggaaaatcggcatcttaactgttagcaaagaaaaaaaaaggctttaactattactagtatccttagatgaatatagctttaaataggtaaactatagctataaagtaaataacaaataagcaaggagattaaatatttatagttacttttttgttcttcgaatttagtaaatttactgttttcaagttgctttacattttgattaaggaagttttcttagagagattaggtatgtaaagcttttcttcgtctatatataagtatagatcgtcctcagaagaacaaattgttttattaagaaaatattttaatccgagcttaattctttcgtctgctatattctaaatgaaatcccgtggtagggagatgttcaaagtcggaccaattgggtcacaacgtgcttatcttaagaatttggaatgggaagagaagggacgcaacatgatctctagtatatatgtcgctttcgacaaagataccataaattctattcagtttagctattgtcagaacggaggtcatgtcgtgtctaaaaagtatggtatgtctgatgcccaaaaacaaaagtatggttcgtacaacggtcgattccacgtaatggtgagactaaatgacgatgagtttgtgaccgggttgagtgcaatatatctttgtaaagggatcacgaatttgaatattcacactaatcaggggaaacacggcccgatttgtgatagatattcatcatcaaagaatattatggataactataaggtggaaattgatgtgaagatacgtaatcgtcgtgagtttggtggtttctttgggtcttttgataactatggcactctgacttccattggcatttatgtgtgtcccattacaaggatcaatgacgtagccctcagaaccaactacaaagtcaccgatgactacgacgaccaaagcactttctatcaatcatctggtcctttaaccacaatcaaccataatcggaagcttgaatatcaaatgcctcatgaggtctccgatgtcaagcccattgttcataaccccaatttcgaagacaagatcagtctctaccaatcatcggatcgtctagccagaagcactaacactctgacacttgagtatcagatccaggagttcctcgatgtcaatcccattggtcgtaagtccaaactcaaatatggcatattctccaagttggcgcgtcttttcagaaatctcttggattagatcttttttttttttcgtttgcattcgtgcaagatccggattggtatgtatttgagtcccacccattacaaggcccgacctggttgacgaagcaacttcttgtggcagtattcaacaatagcttaaataaagtagctttaatgaagcaatgtttgtttcatctttctatatatatcgcaactcttaagt

SEQ ID NO: 6910 - protein, 290 aa, Arabidopsis thaliana
  misc_feature (1)..(290): useful for making plants with modified plant phenotypes as described in USSN 12/139,269
  misc_feature (1)..(290): Utility: Useful for making larger plants
MKSRGREMFKVGPIGSQRAYLKNLEWEEKGRNMISSIYVAFDKDTINSIQFSYCQNGGHVVSKKYGMSDAQKQKYGSYNGRFHVMVRLNDDEFVTGLSAIYLCKGITNLNIHTNQGKHGPICDRYSSSKNIMDNYKVEIDVKIRNRREFGGFFGSFDNYGTLTSIGIYVCPITRINDVALRTNYKVTDDYDDQSTFYQSSGPLTTINHNRKLEYQMPHEVSDVKPIVHNPNFEDKISLYQSSDRLARSTNTLTLEYQIQEFLDVNPIGRKSKLKYGIFSKLARLFRNLLD

SEQ ID NO: 6911 - DNA, 1835 bp, Arabidopsis thaliana
  misc_feature (1)..(1835): useful for making plants with modified plant phenotypes as described in USSN 12/139,269
  misc_feature (1)..(1835): Ceres CLONE ID no. 113719
  misc_feature (1)..(1835): Also known as  Ceres CDNA ID no. 23362877
aaaaacttaaaccgatctatcaagcaagtggttcctctctctctctacctctcgtttttggccaacgtcgtcgtcttcacgatccacgacgattcagttcttgagttccggcgattatcggtctctcacttctggttccgttgaacccctcatttctcttctcgcccgttctctcaaattccgatatttgcccctgtgattcgaaaccctaatttcgcctatcaatctggaaaatctctcaattcgaagactttagcagcgcaaagatactctatccgggtaataagatcgaagaaaccatcaatttcttaccaaagtcgtgattcttggatctcgtctttgtttgatggacacaattagggtccaaggaggttcctggatcttcgaaatcgaccgcacagtcgctcacggagtcgacctctcgcacggaaaccatcaatggctcccacgaattcaagatcagcggctactctttggtcaaaggcatggggattggcaaatacgttacctcggatactttcatggtcggtggatactcctgggccatctacttctacccagatggaaagagtccagaggataattctgtctacgtgtctctcttcatagcccttgcgagtgaaggagccgatgttagggctttgtttgagcttaccctcgtggatcagagcggtaacgaaaggcacaaagttcatagccattttggtagaactctcgaaagcggaccctatactcttaaatatcgagggagtatgtggggatacaaacgatttttcaagaggtctcttttggagtcatcggactatctgaaggacaatggtctcttggtccgttgttgtgttggagtggtgaagtcacgcacagaaggaccgaggtgttacaatatcccggtgccggtttctggcttgggtcagcagtttggaaagcttttggaaagtgggaaaggagctgacgttactttcgaagttgatggagaaacatttcctgctcacaaattggttcttgcagcacgttctgcagttttcagggcacagctttttggcccgttgagaagtgaaaataccaattgtataatcatagaagacgtacaagcccctattttcaagatgttgcttcattttatctactgggatgaaatgcctgatatgcaagacttaatcggcacagacttgaaatgggcatcaactcttgtggctcagcatctgcttgcagctgcagaccgttatgctcttgagcggcttagaacaatatgcgagtcaaaactctgtgaaggaatcagcataaatacggtagcaaccaccttggctcttgcagagcagcatcattgtttccagctgaaagccacctgcctcaaatttatagctttgccagaaaacctgaaagctgtgatggaaacggatgggtttgattatctgaaggaaagctgcccgtccctactaagtgagctattggagtatgtggctaggctgagtgagcactctttaacatcatcagggcatcgaaaggagttatttgctgatggttgtgacttaaatgggagacgtgtgaagcaacggttacattagcaactaattgagagagagagagagagaggtcacttcgagagcctgagaagatgatggtgaagtaaacagaattttagaagagtaaagatttgtgtatttgtcattgtaaaaggattagtggttgatctgtgttgttcagctagctaatagagtgaaatgttgggtttttttcttttcttttctcttttgttttcccaggattttatgaccagaaccggttctctcaaggaaaaagtttcatgtgacttcattgataaatttggacttgcc

SEQ ID NO: 6912 - protein, 359 aa, Arabidopsis thaliana
  misc_feature (1)..(359): useful for making plants with modified plant phenotypes as described in USSN 12/139,269
  misc_feature (145)..(264): Pfam Name: BTB; Pfam Description: BTB/POZ domain
  misc_feature (4)..(121): Pfam Name: MATH; Pfam Description: MATH domain
  misc_feature (1)..(359): Utility: Useful for making larger plants
  misc_feature (1)..(359): Utility: Useful for making lethal plants for genetic confinement systems
  misc_feature (1)..(359): Utility: Useful for making plants with increased biomass and foliage
  misc_feature (1)..(359): Utility: Useful for making smaller plants
MGIGKYVTSDTFMVGGYSWAIYFYPDGKSPEDNSVYVSLFIALASEGADVRALFELTLVDQSGNERHKVHSHFGRTLESGPYTLKYRGSMWGYKRFFKRSLLESSDYLKDNGLLVRCCVGVVKSRTEGPRCYNIPVPVSGLGQQFGKLLESGKGADVTFEVDGETFPAHKLVLAARSAVFRAQLFGPLRSENTNCIIIEDVQAPIFKMLLHFIYWDEMPDMQDLIGTDLKWASTLVAQHLLAAADRYALERLRTICESKLCEGISINTVATTLALAEQHHCFQLKATCLKFIALPENLKAVMETDGFDYLKESCPSLLSELLEYVARLSEHSLTSSGHRKELFADGCDLNGRRVKQRLH

SEQ ID NO: 6913 - protein, 407 aa, Arabidopsis thaliana
  misc_feature (1)..(407): useful for making plants with modified plant phenotypes as described in USSN 12/139,269
  misc_feature (1)..(407): Public GI no. 22531225
  misc_feature (1)..(407): Utility: Useful for making larger plants
  misc_feature (1)..(407): Utility: Useful for making lethal plants for genetic confinement systems
  misc_feature (1)..(407): Utility: Useful for making plants with increased biomass and foliage
  misc_feature (1)..(407): Utility: Useful for making smaller plants
MGTTRVCSEVSSGSSKSLSQSLTVSTSTTETVNGFHEFKICGYSLAKGVGVGKYVASDTFMVGGYSWAIYFYPDGKSPEDNSSYVSLFIALASEGADVRALFELTLVDQSGNGKHKVHSHFGRALDSGPYTLKYRGSMWGYKRFFRRSSLESSDYLKENSLLVRCRVGVVKSVTEGPRYYNIPVPVSNLGQQLGNLLESGKGCDVVFQVDGETFNAHKLVLATRSPVFNAQLFGPLGDRNTKCITIEDMEAPIFKVLLHFIYWDELPDMQELIGTDSTLASTLVAQHLLAAADRYALERLKAICESKLCEGVAINTVATTLALAEQHHCLQLKAVCLKFVALPENLKAVMQTDGFDYLKESCPSLLTELLQYVARLSEHSVIVSGHRKEIFADGCDASGRRVKPRLH

SEQ ID NO: 6914 - protein, 410 aa, Glycine max
  misc_feature (1)..(410): useful for making plants with modified plant phenotypes as described in USSN 12/139,269
  misc_feature (1)..(410): Ceres CLONE ID no. 713993
  misc_feature (1)..(410): Utility: Useful for making larger plants
  misc_feature (1)..(410): Utility: Useful for making lethal plants for genetic confinement systems
  misc_feature (1)..(410): Utility: Useful for making plants with increased biomass and foliage
  misc_feature (1)..(410): Utility: Useful for making smaller plants
MGKILRENAKPSANSSSAYPSAAPATTSSTSVTETVRGSHQFKITGYSLSKGIGIGKYMASDVFSVGGYNWAIYFYPDGKSVEDNATYVSLFIALASEGTDVRALFELTLLDQSGKERHKVHSHFERTLESGPYTLKYRGSMWGYKRFFKRTALETSDYLKDDCLSVNCSVGVVRSHTEGPKIYTIAIPPSSIGQKFGQLLESGKGSDVNFEVNGDIFAAHKLVLAARSPVFRAQLFGPMKDQNTQRIKVEDMEAPVFKALLHFIYWDSLPDMQELTGLNSKWASTLMAQHLLAAADRYGLERLRLMCEASLCEDVAINTVATTLALAEQHHCFQLKAVCLKFIATSENLRAVMQTDGFEYLKESCPSVLTELLEYVARFTEHSDIMCKHRNEALLDGSDINGRRVKQRL

SEQ ID NO: 6915 - protein, 434 aa, Glycine max
  misc_feature (1)..(434): useful for making plants with modified plant phenotypes as described in USSN 12/139,269
  misc_feature (1)..(434): Public GI no. 50939715
  misc_feature (1)..(434): Utility: Useful for making larger plants
  misc_feature (1)..(434): Utility: Useful for making lethal plants for genetic confinement systems
  misc_feature (1)..(434): Utility: Useful for making plants with increased biomass and foliage
  misc_feature (1)..(434): Utility: Useful for making smaller plants
MGAGRACRGGPSSSSPAAAAAAVGRPFPPIAASCPFSSSSAAAAAPAAPSETASTSVTKTVNGSHHFKIAGYPLAKGIGVGKYIASECFTVGGYDWAIYFYPDGKSPEDGAAYVSLFIALASEGTDVRALFELTLVDQSGKGQDKVHTHFGRSLEGGPYTLKYRGSMWGYKRFFKRSALETSDYLKDDCLLVNCTVGVVQSHTEGPKIYTIPVPPSNMSQHIGQLLTDGKRTDITFEVDGEVFPAHKVVLAARSPVFRAQLFGPMKDKNMKRITIEDMEASVFKALLHFMYWDELPDIEELTGLNTTWVSTLMAQHLLAAADRYALERLKLLCELKLCEDVAINTVANTLALAEQHHCYQLKTVCLRFVALPENLKAVMQTDGFDYLQQSCPSLLTELLEYVAKVGEHSVSPCLYSNEVLDGGDANGRRVKPRI

SEQ ID NO: 6916 - protein, 425 aa, Zea mays
  misc_feature (1)..(425): useful for making plants with modified plant phenotypes as described in USSN 12/139,269
  misc_feature (1)..(425): Ceres CLONE ID no. 288779
  misc_feature (1)..(425): Utility: Useful for making larger plants
  misc_feature (1)..(425): Utility: Useful for making lethal plants for genetic confinement systems
  misc_feature (1)..(425): Utility: Useful for making plants with increased biomass and foliage
  misc_feature (1)..(425): Utility: Useful for making smaller plants
MGAGRVCRGGPFSASPAAGAAAGRPFPPLTASSSSPSSAPSETASTSVTKTVNGSHHFKIAGYSLSKGIGVGKFIASESFNVGGFDWAIYFYPDGKSGEDGAAYVSLFIALASEGTDVRALFELTLVDQSGKGQDKVHTHFGRSLESGPYTLKYRGSMWGYKRFFKRVALETSDYLKDDCLLVNCTVGVVQSHTEGPKIYTIPVPRSNMALHIGQLLTSGKRTDIAFEVDGEMFPAHKVILSARSPVFRAQLFGPMKDKDMKCIKIEDMEAPVFKALLHFMYWDELPDLEELTGVNTTWVSTLMAQHLLAAADRYALERLKLLCELKLCEDVAINTVANTLALAEQHHCYQLKTVCLKFVALPENLKAVMQTDGFDYLQQSCPSLLTELLEYVAKIGEHSVSPCLYSTEVLDGGDANGRRVKPRI

SEQ ID NO: 6917 - protein, 422 aa, Zea mays
  misc_feature (1)..(422): useful for making plants with modified plant phenotypes as described in USSN 12/139,269
  misc_feature (1)..(422): Ceres CLONE ID no. 297897
  misc_feature (1)..(422): Utility: Useful for making larger plants
  misc_feature (1)..(422): Utility: Useful for making lethal plants for genetic confinement systems
  misc_feature (1)..(422): Utility: Useful for making plants with increased biomass and foliage
  misc_feature (1)..(422): Utility: Useful for making smaller plants
MGAGRVCRGGPSSVSPAAGRPFSTLAASSSASPSSAPSETASTSVTKTVNGSHHFKIAGYSLSKGIGVGKFIASESFNVGGFDWAIYFYPDGKSAEDGAAYVSLFIALASEGTDVRALFELTLVDQSGKGQDKVHTHFGRSLESGPYTLKYRGSMWGYKRFFKRTALETSDYLKDDCLLVNCTVGVVQSHTEGPKIYTIPVPRSNMALHIGQLLTSGKRTDIAFEVDGEMFPAHKVILSARSPVFRAQLFGPMKDKDMKCIKIEDMEAPVFKALLHFMYWDELPDIEELTGVNTTWVSTLMAQHLLAAADRYALERLKLLCELKLCEDVAINTVANTLALAEQHHCYQLKTVCLKFVALPENLKAVMQTDGFDYLQQSCPSLLTELLEYVAKAGEHSVSPCLYSTEVLDGGDANGRRVKPRI

SEQ ID NO: 6918 - protein, 363 aa, Zea mays
  misc_feature (1)..(363): useful for making plants with modified plant phenotypes as described in USSN 12/139,269
  misc_feature (1)..(363): Public GI no. 31432214
  misc_feature (1)..(363): Utility: Useful for making larger plants
  misc_feature (1)..(363): Utility: Useful for making lethal plants for genetic confinement systems
  misc_feature (1)..(363): Utility: Useful for making plants with increased biomass and foliage
  misc_feature (1)..(363): Utility: Useful for making smaller plants
MSPAARRGNPSRSASAIVADTATGYHLLKVDGYSLTKATPTGSSLTSTQFTVGGHRWRIKYYPNGDSADSADYISIYLLLDEKASLDLKVEAKYLISFADQVKTQPSLKYRTVRTFHRQGSWTWGYGKFIKREDFEKSDHLRDDSFTIRCDILVVHKIHTKETAEILPVETFVSVPPSDMNQQFGDLLETEKGADVVLEVGGQTFAAHRCVLAARSPVFRAELYGLMKEGDTAGVVCIEEMEAQVFKVLLRFLYTDSLPEMKEEEDVMCQHLLVAADRYNLERLKLICEEKLCKYISVGTVSNILALADQHHCDGLKKACFNFLGSPANLSAVVAGDGFKHLSKICPSLMEELVVVLALPGSS

SEQ ID NO: 6919 - protein, 369 aa, Zea mays
  misc_feature (1)..(369): useful for making plants with modified plant phenotypes as described in USSN 12/139,269
  misc_feature (1)..(369): Public GI no. 31432206
  misc_feature (1)..(369): Utility: Useful for making larger plants
  misc_feature (1)..(369): Utility: Useful for making lethal plants for genetic confinement systems
  misc_feature (1)..(369): Utility: Useful for making plants with increased biomass and foliage
  misc_feature (1)..(369): Utility: Useful for making smaller plants
MSPAVGRGNPPSRSASSSTIVAETATGYHLLKINGYSLTKATTPTGSFLPSSPFTVGGHRWNIKYYPNGDDVKTADYISFFLVLEEEETNMGLTVQAKFKFSFANQVKKQPSLKYRPIKTFNLEDSCGWGYVEFIKRVDLEKSDDLRDDSFTIRCDIVVVREIRTEETTEILPVESFVPVPPSDMDQQFGDLLETEKGADVVFEVGGQTFAAHRCVLAARSPVFRAALYGSMKEGDTDGVVHIEDMEAQVFKLLLRFVYTDSLPEMETEEDVVCQHLLVTADRYDLHRLKLMCENRLCKYIGVSTVSNILALADQHHCDGLKKACFSFLGSPANLSAVVASDGFKHLSRSCPSLMEELVVMLALPPSHA

SEQ ID NO: 6920 - protein, 366 aa, Zea mays
  misc_feature (1)..(366): useful for making plants with modified plant phenotypes as described in USSN 12/139,269
  misc_feature (1)..(366): Public GI no. 50928869
  misc_feature (1)..(366): Utility: Useful for making larger plants
  misc_feature (1)..(366): Utility: Useful for making lethal plants for genetic confinement systems
  misc_feature (1)..(366): Utility: Useful for making plants with increased biomass and foliage
  misc_feature (1)..(366): Utility: Useful for making smaller plants
MGDHRDPAFPAAAGGCRLPKTSSVSVTESVTAVHDFKVTGYSLIEGLGIGRYVSSSTFTVGGVDWAVRFYPDGSTVTCLGNASAFLYYCGREKEVRTRFTLNLLGKDGKLSQVTNSYMKHTFSPASDNWGFIKFAEKSKLQSSPFLHNDCLTIRCLLTVVRESHTKDVEVNSVVVPPSNLHTDFENMLQDGEGSDVTFTVGGQEFRAHKCVLAFRSPVFKAELFGPMKENGTQCIKIDDMEPEVFEALLHFIYTDRLPDSCRDGKAAAMQHLLVAADRYGVDRLRLICERRLSETIDVETVATTLVLAEQHHCSQLRQACIGFVASPNMLGPVIESDGFKHLVESCPLIMKEILSKVSHIWIDKSC

SEQ ID NO: 6921 - protein, 348 aa, Triticum aestivum
  misc_feature (1)..(348): useful for making plants with modified plant phenotypes as described in USSN 12/139,269
  misc_feature (1)..(348): Ceres CLONE ID no. 859287
  misc_feature (1)..(348): Utility: Useful for making larger plants
  misc_feature (1)..(348): Utility: Useful for making lethal plants for genetic confinement systems
  misc_feature (1)..(348): Utility: Useful for making plants with increased biomass and foliage
  misc_feature (1)..(348): Utility: Useful for making smaller plants
MRTASMCTASTVRGTHTFKIAGYSLHKGLGVGNFIPSATFDIGGYLWRVLYYPDGEMEMENGDHASVFLDLVSEDTEARAFFEVRLVDKTNKLPPSVVLSQKTPYVFNSNGRRSSVGDDFLQPSAYLLDDSLVLECDVTVLRESKVTLTATTFDIQVPPSDLGEHFRELLEKEEEADVVFEVEGEVFPAHKIVVAGRSPVFKAQLFGPMSDRAKQRITVEDMQPAVFKALLHFIYTDSLPSMEKLDGDEGKEMVKHLLVAADRYAMERMKVMCESILCKSLDVENVTATLALADQHHCSNLRDACLEFITSTDRMDDVMASQGYAHLKRSCPSIVIDVLEKAKKSRKI

SEQ ID NO: 6922 - protein, 382 aa, Triticum aestivum
  misc_feature (1)..(382): useful for making plants with modified plant phenotypes as described in USSN 12/139,269
  misc_feature (1)..(382): Public GI no. 31432164
  misc_feature (1)..(382): Utility: Useful for making larger plants
  misc_feature (1)..(382): Utility: Useful for making lethal plants for genetic confinement systems
  misc_feature (1)..(382): Utility: Useful for making plants with increased biomass and foliage
  misc_feature (1)..(382): Utility: Useful for making smaller plants
MPASAAATTGSSDGGRPPHYSSASAIVGGTVTGHHILQIDGYSYTKEKLPSGKFIQSRSFKVGDHQWRLSYFPNVKGSDYADYISVYLCLVEGQPVKARATFSLLDRAGQPAPASASYYTRDMPMGRFAVSDIGFGYHQFIKRELLEKSGHVRDDGFAIRCDVTVVTELRTEDRTPPLVEVPPPDLRRHLGGLLESGDGADVTFHVAGEEVRAHRYILAARSPVFKAELFGQMKESSSSNTVVNVDDMEAEVFRALLVFIYTNALPETKTKANQEDELVIAQHLLVAADRYGMERLKLLCEEKLVEYIDRGSAVMLMALAEQHHCHGLKEVCFRFLESKETLSAVMATDGFLHLMQSCPSLVKELLFRVVDHSLEITHVVRL

SEQ ID NO: 6923 - protein, 384 aa, Triticum aestivum
  misc_feature (1)..(384): useful for making plants with modified plant phenotypes as described in USSN 12/139,269
  misc_feature (1)..(384): Public GI no. 50942543
  misc_feature (1)..(384): Utility: Useful for making larger plants
  misc_feature (1)..(384): Utility: Useful for making lethal plants for genetic confinement systems
  misc_feature (1)..(384): Utility: Useful for making plants with increased biomass and foliage
  misc_feature (1)..(384): Utility: Useful for making smaller plants
MVASASRLRPSSTTRTASSCKPETARGTHVFTIHGYSLQAVDGAGSNKASFIRSAAFDVGGFDWCLRYYHNGNIESDDDYISVFLELMTKDAEVRTIFDIRMLDQYTDDSSCVLVSTTNNTRRVFGTTNFKSKCLVWGSKNFIRRSELEGSVYLRDDRLMIECNLTVIKTPLVKTEERAAMPGDIIHFQVPPTNLSRDLGKLLEDNVGADLSFEVGGDVFPAHSVVLAARSPVFMAELYGPMRAKRGERIAIQDMQPVVFKALLHFMYTDSFSPAINDDLSRDERQELAKHLLVAADRYAVEGLKTICEKALCMSLSVDNVATIVALADQHNCGRLKEACVKFIASSNRLDDVVETEGYGRLKTSCPSILLDVIEMATKSRKIN

SEQ ID NO: 6924 - DNA, 440 bp, Arabidopsis thaliana
  misc_feature (1)..(440): useful for making plants with modified plant phenotypes as described in USSN 12/139,269
  misc_feature (1)..(440): Ceres CLONE ID no. 147593
  misc_feature (1)..(440): Also known as  Ceres CDNA ID no. 23380962
aaattttttccctcttacgacgatttcgagttcgagagagaagaatggaggtggtggagaggaagacggagatggcggaggaaggatgtacgacgccgagaagcacgatgtataggattccggtggcgtctgtttgtccaccgccgccgaggaagaagttgatggtggtgagaaaacgagatccgccgaggaacgggtactttcagccaccagatcttgaaactttgttctacgcacagcctcgaagagaagcttccgcttagattttgagatttgatttgatttgaattatctaggttttttttttactttcttctctgtagatacatgtttagggtttgttctcttattagattttatttatctttcagagagatgactttgtttgtgtatcgaaattggaatttgctaaaatgaaactttgatctgttttccaattc

SEQ ID NO: 6925 - protein, 72 aa, Arabidopsis thaliana
  misc_feature (1)..(72): useful for making plants with modified plant phenotypes as described in USSN 12/139,269
  misc_feature (1)..(72): Utility: Useful for making larger plants
  misc_feature (1)..(72): Utility: Useful for making ornamental plants with modified flowers
  misc_feature (1)..(72): Utility: Useful for making plants sterile and for genetic confinement
  misc_feature (1)..(72): Utility: Useful for making plants with increased biomass and foliage
  misc_feature (1)..(72): Utility: Useful for making shorter plants and plants with modified flowers
  misc_feature (1)..(72): Utility: Useful for making smaller plants
MEVVERKTEMAEEGCTTPRSTMYRIPVASVCPPPPRKKLMVVRKRDPPRNGYFQPPDLETLFYAQPRREASA

SEQ ID NO: 6926 - protein, 50 aa, Brassica napus
  misc_feature (1)..(50): useful for making plants with modified plant phenotypes as described in USSN 12/139,269
  misc_feature (1)..(50): Ceres CLONE ID no. 1090124
  misc_feature (1)..(50): Utility: Useful for making larger plants
  misc_feature (1)..(50): Utility: Useful for making ornamental plants with modified flowers
  misc_feature (1)..(50): Utility: Useful for making plants sterile and for genetic confinement
  misc_feature (1)..(50): Utility: Useful for making plants with increased biomass and foliage
  misc_feature (1)..(50): Utility: Useful for making shorter plants and plants with modified flowers
  misc_feature (1)..(50): Utility: Useful for making smaller plants
MEEVVERTTEMAEEGCTTPRSSKYRIPVSLVCPPPPRKKSMVARKRDPPR

SEQ ID NO: 6927 - protein, 82 aa, Brassica napus
  misc_feature (1)..(82): useful for making plants with modified plant phenotypes as described in USSN 12/139,269
  misc_feature (1)..(82): Public GI no. 8778541
  misc_feature (1)..(82): Utility: Useful for making larger plants
  misc_feature (1)..(82): Utility: Useful for making ornamental plants with modified flowers
  misc_feature (1)..(82): Utility: Useful for making plants sterile and for genetic confinement
  misc_feature (1)..(82): Utility: Useful for making plants with increased biomass and foliage
  misc_feature (1)..(82): Utility: Useful for making shorter plants and plants with modified flowers
  misc_feature (1)..(82): Utility: Useful for making smaller plants
MEEKNYDDGDTVTVDDDYQMGCTTPTRDDCRIPAYPPCPPPVRRKRSLLGFGKKREPPKKGYFQPPDLDLFFSVVAASQAAT

SEQ ID NO: 6928 - protein, 89 aa, Triticum aestivum
  misc_feature (1)..(89): useful for making plants with modified plant phenotypes as described in USSN 12/139,269
  misc_feature (1)..(89): Ceres CLONE ID no. 912191
  misc_feature (1)..(89): Utility: Useful for making larger plants
  misc_feature (1)..(89): Utility: Useful for making ornamental plants with modified flowers
  misc_feature (1)..(89): Utility: Useful for making plants sterile and for genetic confinement
  misc_feature (1)..(89): Utility: Useful for making plants with increased biomass and foliage
  misc_feature (1)..(89): Utility: Useful for making shorter plants and plants with modified flowers
  misc_feature (1)..(89): Utility: Useful for making smaller plants
MEVEVPMEYGVTTTTVAEEQGWETPRREDCRIPALPTCPPPPPRKKPAAELGRAAPRRGPPKGGYFQPPDIESLFLLAPPRRHAASTCA

SEQ ID NO: 6929 - protein, 90 aa, Zea mays
  misc_feature (1)..(90): useful for making plants with modified plant phenotypes as described in USSN 12/139,269
  misc_feature (1)..(90): Ceres CLONE ID no. 297709
  misc_feature (1)..(90): Utility: Useful for making larger plants
  misc_feature (1)..(90): Utility: Useful for making ornamental plants with modified flowers
  misc_feature (1)..(90): Utility: Useful for making plants sterile and for genetic confinement
  misc_feature (1)..(90): Utility: Useful for making plants with increased biomass and foliage
  misc_feature (1)..(90): Utility: Useful for making shorter plants and plants with modified flowers
  misc_feature (1)..(90): Utility: Useful for making smaller plants
MESSVGIEKAAAVAVGAGVGGGGGGYGCGGWETPKREECRIPATLPCPAAPRKAVPDFGKRRSPPKNGYFQPPDLEALFALAPRRQAFCA

SEQ ID NO: 6930 - protein, 83 aa, Triticum aestivum
  misc_feature (1)..(83): useful for making plants with modified plant phenotypes as described in USSN 12/139,269
  misc_feature (1)..(83): Ceres CLONE ID no. 937009
  misc_feature (1)..(83): Utility: Useful for making larger plants
  misc_feature (1)..(83): Utility: Useful for making ornamental plants with modified flowers
  misc_feature (1)..(83): Utility: Useful for making plants sterile and for genetic confinement
  misc_feature (1)..(83): Utility: Useful for making plants with increased biomass and foliage
  misc_feature (1)..(83): Utility: Useful for making shorter plants and plants with modified flowers
  misc_feature (1)..(83): Utility: Useful for making smaller plants
  misc_feature (8)..(8): Xaa is any aa, unknown or other
  misc_feature (59)..(59): Xaa is any aa, unknown or other
  misc_feature (81)..(81): Xaa is any aa, unknown or other
MAMESGAXAAAAAAAGYYGGNCGWETPKREECRIPATLPCPAAPRKAAADFGTPRRPPXNGYFQPPDLEALFALAPRRQAXCA

SEQ ID NO: 6931 - protein, 92 aa, Triticum aestivum
  misc_feature (1)..(92): useful for making plants with modified plant phenotypes as described in USSN 12/139,269
  misc_feature (1)..(92): Public GI no. 34908220
  misc_feature (1)..(92): Utility: Useful for making larger plants
  misc_feature (1)..(92): Utility: Useful for making ornamental plants with modified flowers
  misc_feature (1)..(92): Utility: Useful for making plants sterile and for genetic confinement
  misc_feature (1)..(92): Utility: Useful for making plants with increased biomass and foliage
  misc_feature (1)..(92): Utility: Useful for making shorter plants and plants with modified flowers
  misc_feature (1)..(92): Utility: Useful for making smaller plants
MESKAEALAAAAAAAAAAASAASTGGGHACGGWETPKREECRIPATLPCPAAPRKAVPDFGKRRGPPKNGYFQPPDLEALFALAPRRQASSY

SEQ ID NO: 6932 - protein, 81 aa, Triticum aestivum
  misc_feature (1)..(81): useful for making plants with modified plant phenotypes as described in USSN 12/139,269
  misc_feature (1)..(81): Ceres CLONE ID no. 1052536
  misc_feature (1)..(81): Utility: Useful for making larger plants
  misc_feature (1)..(81): Utility: Useful for making ornamental plants with modified flowers
  misc_feature (1)..(81): Utility: Useful for making plants sterile and for genetic confinement
  misc_feature (1)..(81): Utility: Useful for making plants with increased biomass and foliage
  misc_feature (1)..(81): Utility: Useful for making shorter plants and plants with modified flowers
  misc_feature (1)..(81): Utility: Useful for making smaller plants
MAMESGSEAAAAAGYYGGTCGWETPKREECRILATLPCPAAPRKAAADFGTPRRPPKNGYFQPPDLEALFALAPRRQASCA

SEQ ID NO: 6933 - protein, 65 aa, Glycine max
  misc_feature (1)..(65): useful for making plants with modified plant phenotypes as described in USSN 12/139,269
  misc_feature (1)..(65): Ceres CLONE ID no. 630011
  misc_feature (1)..(65): Utility: Useful for making larger plants
  misc_feature (1)..(65): Utility: Useful for making ornamental plants with modified flowers
  misc_feature (1)..(65): Utility: Useful for making plants sterile and for genetic confinement
  misc_feature (1)..(65): Utility: Useful for making plants with increased biomass and foliage
  misc_feature (1)..(65): Utility: Useful for making shorter plants and plants with modified flowers
  misc_feature (1)..(65): Utility: Useful for making smaller plants
MEWEDECRTPRLVQNQIPAVFICPPPPPRKKPVAGKRRPPPKEGYFHPPDLDSLFSVPARKEACV

SEQ ID NO: 6934 - DNA, 1186 bp, Arabidopsis thaliana
  misc_feature (1)..(1186): useful for making plants with modified plant phenotypes as described in USSN 12/139,269
  misc_feature (1)..(1186): Ceres CLONE ID no. 150798
  misc_feature (1)..(1186): Also known as  Ceres CDNA ID no. 23375985
accatccactctactcaacatggactcctccaaactctcatctctctctctttgcctcttcctcatttgcattatctatctcccccaacattctctcgcatgcggctcttgcaacccacggaagggcggaaagcactcccctaagctaccagttcctccggtgaccgtccctaagctaccagttcctccggtgaccgtccctaagctaccagtccctccggtgaccgtccctaagctacccgttcctcctgtgaccatccctaagctacccgttccaccagtgactgtacctaagctacccgttcctcctgtgaccgtccccaagctacccgttcctccagtgaccgtccccaagctacccgttcctccagtgacagtccctaagctacccgttcccccggtaactgtacctaagctacccgttcctccagtgaccgtccctaagctaccccttcctccgatttcagggctacccatacctccagtggtaggtcccaatctgccattgccacctttgccaattgtaggtcctattcttccaccgggaacaaccccaccagccacaggagggaaggactgtcctccaccgccagggagcgtaaagccaccatcagggggcgggaaggcgacatgtccaatagacacgctgaagttaggtgcttgcgtcgacttgttgggaggtttagtaaagatagggcttggggatccagcagttaacaaatgttgtccgttacttaaaggcctcgttgaaatcgaagccgcggcttgtctctgcactaccctcaagctcaaagctcttgacctcaatctttatgtccctgatgctcttcagcttctccttacctgtggcaaaaatccacctccgggctacacttgttccatatgataaactcactccacttataaaggatgctttggagaaaaaagtgagaagagaatggcagagctccaatctttcctgtcttggtttaccaaatacatcatatcaaatcctatccctttgattctttcctctatcgttcccttatgcttgtatcattaattaatgtgtgctttttagattaatgattcttctcttgtattaaagtatgatttgaaatcctttttttttctctatctctttttattgaattgattgaactgcgttcatgatactgtcaaaaagagagaaaaagagtacaatttt

SEQ ID NO: 6935 - protein, 288 aa, Arabidopsis thaliana
  misc_feature (1)..(288): useful for making plants with modified plant phenotypes as described in USSN 12/139,269
  misc_feature (205)..(286): Pfam Name: Tryp_alpha_amyl; Pfam Description: Protease inhibitor/seed storage/LTP family
  misc_feature (1)..(288): Utility: Useful for making larger plants
MDSSKLSSLSLCLFLICIIYLPQHSLACGSCNPRKGGKHSPKLPVPPVTVPKLPVPPVTVPKLPVPPVTVPKLPVPPVTIPKLPVPPVTVPKLPVPPVTVPKLPVPPVTVPKLPVPPVTVPKLPVPPVTVPKLPVPPVTVPKLPLPPISGLPIPPVVGPNLPLPPLPIVGPILPPGTTPPATGGKDCPPPPGSVKPPSGGGKATCPIDTLKLGACVDLLGGLVKIGLGDPAVNKCCPLLKGLVEIEAAACLCTTLKLKALDLNLYVPDALQLLLTCGKNPPPGYTCSI

SEQ ID NO: 6936 - protein, 190 aa, Glycine max
  misc_feature (1)..(190): useful for making plants with modified plant phenotypes as described in USSN 12/139,269
  misc_feature (1)..(190): Ceres CLONE ID no. 814247
  misc_feature (1)..(190): Utility: Useful for making larger plants
MESSKIYAYLFLCMIFLSSATPILGCGYCGKPPKKHKPGKTPKTPKTPVVKPPVTIPPINVPPVVLPPIVKPPGILPPIPIINPPTTPGKGGNTPCPPPKSPAQATCPIDTLKLGACVDLLGGLVHIGLGDPVANQCCPVLQGLVEVEAAVCLCTTLKLKLLNLNIYVPLALQLLVTCGKSPPPGYTCSL

SEQ ID NO: 6937 - protein, 258 aa, Glycine max
  misc_feature (1)..(258): useful for making plants with modified plant phenotypes as described in USSN 12/139,269
  misc_feature (1)..(258): Ceres CLONE ID no. 467982
  misc_feature (1)..(258): Utility: Useful for making larger plants
  misc_feature (28)..(28): Xaa is any aa, unknown or other
  misc_feature (47)..(47): Xaa is any aa, unknown or other
MSQNLLTTLNHQCHPHPPHVPKPHPKPXLHPHPPYVPKPPVVKPPYXPKPPVVNPPYVPKPPVVPVTPPYVPKPPIVNPPYVPKPPVVPVRPPYIPKPPVVPVTPPYVPKPPIVYPPVVPTPPIVTPPIVYPPVVPVPPLPPIVTPPNPPSETPCPPPPPPPVVPYPPPAQPTCPIDSLKLGACVDVLGGLIHIGIGSSAKQTCCPVLAGLVDLDAAVCLCTTIRAKILNINIIIPIALQLLIDCGKTPPDGFKCADS

SEQ ID NO: 6938 - protein, 228 aa, Glycine max
  misc_feature (1)..(228): useful for making plants with modified plant phenotypes as described in USSN 12/139,269
  misc_feature (1)..(228): Ceres CLONE ID no. 541495
  misc_feature (1)..(228): Utility: Useful for making larger plants
PKPPVVPVTPPYIPKPPVVTPPYVPKPPVVPVTPPYVPKPPVVPVTPPYVPKPPIVKPPIVYPPVVPKPPIVTPPYVPKPPIVKPPIVYPPVVPTPPIVYPPVVPTPPVVTPPVVTPPSPPSETPCPPPPPPVVPYPPPAQPTCPIDTLKLGACVDVLGGLIHIGIGSSAQQTCCPVLAGLVDLDAAVCLCTTIRAKILNINIIIPIALQLLIDCGKTPPDGFKCADS

SEQ ID NO: 6939 - DNA, 839 bp, Arabidopsis thaliana
  misc_feature (1)..(839): useful for making plants with modified plant phenotypes as described in USSN 12/139,269
  misc_feature (1)..(839): Ceres CLONE ID no. 152076
  misc_feature (1)..(839): Also known as  Ceres CDNA ID no. 23361565
aaaaaaccctaattcctccatttcgaaattccaacgaattctctggtgattttaccaaaggcgatggcaacatcgatgagtttgaatctaattggggcattcaaaggcttgtctctctcttcaacctcgtcttttctcagaggcgagttgagtttttcccccaaaacaactttcactgttactcttcctctggaaaatcttcaagctccggttccgttgacaattgaatcggcccataagaaaggagctggtagcaccaagaacggtcgtgattctcctgggcaacgactcggcgtcaagatctacggtgaccaagttgctaaacctggtgctatcattgttcgtcaacgtggcactaagttccatgctgggaaaaatgttgggattggtaaagatcataccatcttctctttaatcgatggattagtcaagttcgagaagtttggtcctgacaggaagaagataagtgtgtatccaagagaaattgtaccagagaatcccaatagctacagagcaagaaagagagaaaacttcagattgcaaagggagaagaagaaggcgagacgtgagaattacacttacacacttcctacacctgaacttgttcttgcatctgcatcaatcgatgatgctgaagccaatccggagtgctagaagatcgaatgtgaagttttcattatctctttttgtttagtcttgttcatgaaaatgatcctttcagagtattaagagttggttgtattgtcgaatccaagcctctcttttgtcaaattgagtcccaagcaggcggatttttacccaacttgagttcagagtgtaatcaaatgggttatttgttt

SEQ ID NO: 6940 - protein, 196 aa, Arabidopsis thaliana
  misc_feature (1)..(196): useful for making plants with modified plant phenotypes as described in USSN 12/139,269
  misc_feature (57)..(137): Pfam Name: Ribosomal_L27; Pfam Description: Ribosomal L27 protein
  misc_feature (57)..(137): Pfam Name: Ribosomal_L27; Pfam Description: Ribosomal L27 protein
  misc_feature (1)..(196): Utility: Useful for making larger plants
  misc_feature (1)..(196): Utility: Useful for making smaller plants
MATSMSLNLIGAFKGLSLSSTSSFLRGELSFSPKTTFTVTLPLENLQAPVPLTIESAHKKGAGSTKNGRDSPGQRLGVKIYGDQVAKPGAIIVRQRGTKFHAGKNVGIGKDHTIFSLIDGLVKFEKFGPDRKKISVYPREIVPENPNSYRARKRENFRLQREKKKARRENYTYTLPTPELVLASASIDDAEANPEC

SEQ ID NO: 6941 - protein, 198 aa, Arabidopsis thaliana
  misc_feature (1)..(198): useful for making plants with modified plant phenotypes as described in USSN 12/139,269
  misc_feature (1)..(198): Public GI no. 21436345
  misc_feature (1)..(198): Utility: Useful for making larger plants
  misc_feature (1)..(198): Utility: Useful for making smaller plants
MAMATSMSLNLIGAFKGLSLSSTSSFLRGDLSFSPKTSFTVTLPLENLQAPIPLTIESAHKKGAGSTKNGRDSPGQRLGVKIYGDQVAKPGAIIVRQRGTKFHAGKNVGIGKDHTIFSLIDGLVKFEKFGPDRKKISVYPREIVPENPNSYRARKRENFRLQREKKKARRENYSYTLPTPELVLASASVDDAEANPEC

SEQ ID NO: 6942 - protein, 190 aa, Glycine max
  misc_feature (1)..(190): useful for making plants with modified plant phenotypes as described in USSN 12/139,269
  misc_feature (1)..(190): Ceres CLONE ID no. 543435
  misc_feature (1)..(190): Utility: Useful for making larger plants
  misc_feature (1)..(190): Utility: Useful for making smaller plants
  misc_feature (160)..(160): Xaa is any aa, unknown or other
MATASMCMSFNLATAFKGLSLSSSSSFFGGSSGSLRAGPASVVSLPRRCPLTIENAHKKGAGSTKNGRDSQGKRLGVKIYGDQVAKPGSIIVRQRGTKFHAGKNVGLGKDYTIFSLIDGVVKFEKYGPDRKKVSVYPREVQPENPNSYRARKREYFRVRXERKKARQGAILKSQLVLASADDAAITNPMC

SEQ ID NO: 6943 - protein, 179 aa, Glycine max
  misc_feature (1)..(179): useful for making plants with modified plant phenotypes as described in USSN 12/139,269
  misc_feature (1)..(179): Public GI no. 282960
  misc_feature (1)..(179): Utility: Useful for making larger plants
  misc_feature (1)..(179): Utility: Useful for making smaller plants
MAVSFSLVGAFKGLSLASSSSFLKGDFGAAFPVAPKFSVSFPLKSPLTIESAHKKGAGSTKNGRDSPGQRLGVKIFGDQVAKPGSIIVRQRGTKFHPGKNVGLGKDHTIFSLIDGLVKFEKFGPDRKKISVYPREVQPENPNSYRNRKRESFRLQRERRKARREGVILQSSVDTCFCCC

SEQ ID NO: 6944 - protein, 180 aa, Zea mays
  misc_feature (1)..(180): useful for making plants with modified plant phenotypes as described in USSN 12/139,269
  misc_feature (1)..(180): Ceres CLONE ID no. 291623
  misc_feature (1)..(180): Utility: Useful for making larger plants
  misc_feature (1)..(180): Utility: Useful for making smaller plants
MAFALAGAFKGLSLVPATTSSFPRGDRASLSVGGAAGVPVPVPARRLTIQMAHKKGAGSTKNGRDSKGQRLGVKIYGDQLAKPGAIIIRQRGTRVYPGNNVGMGKDHTLFSLIDGLVKFEKYGPDKKKVSVYPYEKEPENPNSYRARKREYFRMRRERKKARAEGAAEPQLVLAAVDENS

SEQ ID NO: 6945 - protein, 195 aa, Zea mays
  misc_feature (1)..(195): useful for making plants with modified plant phenotypes as described in USSN 12/139,269
  misc_feature (1)..(195): Public GI no. 50904335
  misc_feature (1)..(195): Utility: Useful for making larger plants
  misc_feature (1)..(195): Utility: Useful for making smaller plants
MASMAFTLVGAFKGMSLSSPCHSSSSASFLRADRVSLSVGGGVGMGVPMTMPVRRLTIQMAHKKGAGSTKNGRDSPGQRLGVKIYGDQVAKPGAIIIRQRGTRVYPGNNVGMGKDHTLFSLIDGLVKFEKYGPDKKKVSVYPYEKQPENPNSYRARKREYFRMQRERKKARAEGIVEVQLVLAAADESPEVNADC

SEQ ID NO: 6946 - DNA, 1318 bp, Arabidopsis thaliana
  misc_feature (1)..(1318): useful for making plants with modified plant phenotypes as described in USSN 12/139,269
  misc_feature (1)..(1318): Ceres CLONE ID no. 154031
  misc_feature (1)..(1318): Also known as  Ceres CDNA ID no. 23389460
tctttttactgtttccccaaaaattcttttgaaaatcgaatcgacaaattccttccgccgtcggaatgtcaattcccgatcccaactcctccgcatctctaacggtgtctccgtctctatccaccgcatcggaaactccggtaacaccagtaaacactgttagaccaccgccgtctcagccacctcctgctccgccgccactaccgccgccgacttacagacccatagctccgcttcgccaccctaatccgttccaacaacaatctgcttatagtaataacctctacgcacattcgattccggtcagacgccaaattcaagatccgtcagctgttctttacccgtttgctctaccgggtcgagggttttcagcccgacctgttcgaggattcgtcgcagatccttccgtgacggctggtaatctgagtgggtaccctcctcgcccgagttttacttacgatcctggaccatatgagcagcgtcaaatggaatccttgttgcagcagtttataagggagagaaatcctcagattcgtccattaccacgccttggattgggttctcctgttgggttgggtcccattagagcaagtcctcaatttctgcaaccgcgggttgccccgcccccaacttcaattctagacactagcaggaatagaaaggccagaagcaaggatggggctcttgccgttgttagagggagaaaggtccgaatcactgaggggtcttcttctctttattcacttggtcgatcgtggttgaaaaatggtgctcacgttggaattcagccgcaaaggagtggtataatgaaacctttgccaaaaccgttacctgtggatttaacaacagagacaagtgtaccagatgatccagatgaagaatcagcggatgaagacaaagaggacgaggaagctgtaaagcaattatctgagaaggatcttttgaaaagacacatcgagcgagctaagaaagtccgtgcacaattacgagaagaacggtcaagaaggatcaggaggtacaaagaaagaataactcttattctggcacaatccgaagaccgatgatgcttgaagaacgactaaaaaagggtaaagttttgttaggaattagcttcatatgactgttgttgatttagcatactagtaccacgtaacaacatacgtgtagtaatagtataggtgtgttcttcttcgtcttctatagattagtaggactactcaatgaatagtgtttcattcttcctaaaactaaagaggaagataaaattgtttccttaaagtcagcttttactaatttgacaataaaaatttcttctctc

SEQ ID NO: 6947 - protein, 332 aa, Arabidopsis thaliana
  misc_feature (1)..(332): useful for making plants with modified plant phenotypes as described in USSN 12/139,269
  misc_feature (1)..(332): Utility: Useful for making larger plants
  misc_feature (1)..(332): Utility: Useful for making smaller plants
MSIPDPNSSASLTVSPSLSTASETPVTPVNTVRPPPSQPPPAPPPLPPPTYRPIAPLRHPNPFQQQSAYSNNLYAHSIPVRRQIQDPSAVLYPFALPGRGFSARPVRGFVADPSVTAGNLSGYPPRPSFTYDPGPYEQRQMESLLQQFIRERNPQIRPLPRLGLGSPVGLGPIRASPQFLQPRVAPPPTSILDTSRNRKARSKDGALAVVRGRKVRITEGSSSLYSLGRSWLKNGAHVGIQPQRSGIMKPLPKPLPVDLTTETSVPDDPDEESADEDKEDEEAVKQLSEKDLLKRHIERAKKVRAQLREERSRRIRRYKERITLILAQSEDR

SEQ ID NO: 6948 - protein, 274 aa, Glycine max
  misc_feature (1)..(274): useful for making plants with modified plant phenotypes as described in USSN 12/139,269
  misc_feature (1)..(274): Ceres CLONE ID no. 636116
  misc_feature (1)..(274): Utility: Useful for making larger plants
  misc_feature (1)..(274): Utility: Useful for making smaller plants
MPLDPAAATTTASRPISPLPQPQQQHHHHYPSQQQTLPILAPNPHFVYPFAPKGVRAADHAGVSAAFPPPSMMYSGGVRGVPLDYFSHALHVGRPPTHVPFPHAAPAASPPVKKAAARSAVADVNGGKDTNTREKSSEDTFIVVRDRKVRVTDDASLYALCRSWLRNGINEESQPQQKDVIKALPKPLPASMVASYLSNKKEDEKDEDEKEENEQSVEHLSPQDLLKRHIKRAKNVRARLREERLQRITRYRSRLRLLLPPAIEQCRNDTAAGN

SEQ ID NO: 6949 - protein, 310 aa, Zea mays
  misc_feature (1)..(310): useful for making plants with modified plant phenotypes as described in USSN 12/139,269
  misc_feature (1)..(310): Ceres CLONE ID no. 286081
  misc_feature (1)..(310): Utility: Useful for making larger plants
  misc_feature (1)..(310): Utility: Useful for making smaller plants
MSSPPRGQPATAAVPAVAAATSPQLPAASHTLPRAFLATSSPRAIVAAPAPPLFTGRPLNPNPPAHGSSVPHGILYPVLKSASTSNSAAAAVTAQLRRVPPMAVGYPRTHAVAIPIAQQQQPLVHAQPRSFAAVPRALVTGVSTGSEQPPRGVPIGSQPKVNPVPPVGPSNEQSNPKDREKSREEPTVVVINDRKVNLLDSESGSFYALCRSWVRNGVPHESQPSFGNGEPLLPRPLPASVVDSRISDKDDNDVAGEDSDEEPQKNANGEYNTSDLLKQHVKRAKRIRAGLQKDRLRRIERYKQRLALLL

SEQ ID NO: 6950 - DNA, 1305 bp, Zea mays
  misc_feature (1)..(1305): useful for making plants with modified plant phenotypes as described in USSN 12/139,269
  misc_feature (1)..(1305): Ceres CLONE ID no. 246416
  misc_feature (1)..(1305): Also known as  Ceres CDNA ID no. 23783423
aaaaaaccgccccctcccttcctcttctcctagctctcttgcctgcgcaccactcgagtcgagactcgagaggcacctgatctttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactaccaataaagtcaggccccgtcaaatgctttacatggtgattgaagtctggagcttctcagcaccaccatatattgtgttcagttcctgtgtttattgccatagctaccctttttttctctgatctacgagctagacgtagctttgtgcttggagattccactactatgtttcctctgtcctgtgtatgctttaacggagatgcacgttgtacccgtggtaatatatataaatttgcgttgt

SEQ ID NO: 6951 - protein, 251 aa, Zea mays
  misc_feature (1)..(251): useful for making plants with modified plant phenotypes as described in USSN 12/139,269
  misc_feature (9)..(59): Pfam Name: SRF-TF; Pfam Description: SRF-type transcription factor (DNA-binding and dimerisation domain)
  misc_feature (76)..(173): Pfam Name: K-box; Pfam Description: K-box region
  misc_feature (1)..(251): Utility: Useful for making larger plants
  misc_feature (1)..(251): Utility: Useful for making plants that flower early
  misc_feature (1)..(251): Utility: Useful for making plants with increased biomass
  misc_feature (1)..(251): Utility: Useful for making plants with increased biomass and foliage
  misc_feature (1)..(251): Utility: Useful for making smaller plants
MGRGPVQLRRIENKINRQVTFSKRRNGLLKKAHEISVLCDAEVALIVFSTKGKLYEYSSHSSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQHRGAAESESEPSPAPAQANRGNLPPWMLRTVK

SEQ ID NO: 6952 - protein, 265 aa, Zea mays
  misc_feature (1)..(265): useful for making plants with modified plant phenotypes as described in USSN 12/139,269
  misc_feature (1)..(265): Public GI no. 9367307
  misc_feature (1)..(265): Utility: Useful for making larger plants
  misc_feature (1)..(265): Utility: Useful for making plants that flower early
  misc_feature (1)..(265): Utility: Useful for making plants with increased biomass
  misc_feature (1)..(265): Utility: Useful for making plants with increased biomass and foliage
  misc_feature (1)..(265): Utility: Useful for making smaller plants
MGRGPVQLRRIENKINRQVTFSKRRSGLLKKAHEISVLCDAEVALIVFSTKGKLYEYSSQDSSMDVILERYQRYSFEERAVLDPSTGDQANWGDEYGSLKIKLDALQKSQRQLLGEQLDPLTTKELQQLEQQLDSSLKHIRSRKNQLLFESISELQKKEKSLKDQNGVLQKHLVETEKEKNNVLSNIHHREQLNEATNIHHQEQLSGATTSSPSPTPPTAQDSMAPPNIGPYQSRGGGDPEPQPSPAQANNSNLPPWMLRTIGNR

SEQ ID NO: 6953 - protein, 249 aa, Zea mays
  misc_feature (1)..(249): useful for making plants with modified plant phenotypes as described in USSN 12/139,269
  misc_feature (1)..(249): Public GI no. 62510920
  misc_feature (1)..(249): Utility: Useful for making larger plants
  misc_feature (1)..(249): Utility: Useful for making plants that flower early
  misc_feature (1)..(249): Utility: Useful for making plants with increased biomass
  misc_feature (1)..(249): Utility: Useful for making plants with increased biomass and foliage
  misc_feature (1)..(249): Utility: Useful for making smaller plants
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTIKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 6954 - protein, 249 aa, Zea mays
  misc_feature (1)..(249): useful for making plants with modified plant phenotypes as described in USSN 12/139,269
  misc_feature (1)..(249): Public GI no. 6175371
  misc_feature (1)..(249): Utility: Useful for making larger plants
  misc_feature (1)..(249): Utility: Useful for making plants that flower early
  misc_feature (1)..(249): Utility: Useful for making plants with increased biomass
  misc_feature (1)..(249): Utility: Useful for making plants with increased biomass and foliage
  misc_feature (1)..(249): Utility: Useful for making smaller plants
MGRGPVQLRRIENKINRQVTFSKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTTKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 6955 - protein, 238 aa, Zea mays
  misc_feature (1)..(238): useful for making plants with modified plant phenotypes as described in USSN 12/139,269
  misc_feature (1)..(238): Public GI no. 7677036
  misc_feature (1)..(238): Utility: Useful for making larger plants
  misc_feature (1)..(238): Utility: Useful for making plants that flower early
  misc_feature (1)..(238): Utility: Useful for making plants with increased biomass
  misc_feature (1)..(238): Utility: Useful for making plants with increased biomass and foliage
  misc_feature (1)..(238): Utility: Useful for making smaller plants
ENTMNRQVTFFKRRNGLLKKAHEISVLCDADVALIVFSTKGKLYEFSSHSSMEGILERYQRYSFDERAVLEPNTEDQENWGDEYGILKSKLDALQKSQRQLLGEQLDTLTTKELQQLEHQLEYSLKHIRSKKNQLLFESISELQKKEKSLKNQNNVLQKLMETEKEKNNAIINTNREEQNGATPSTSSPTPVTAPDPIPTTNNSQSQPRGSGESEAQPSPAQAGNSKLPPWMLRTSHT

SEQ ID NO: 6956 - protein, 250 aa, Zea mays
  misc_feature (1)..(250): useful for making plants with modified plant phenotypes as described in USSN 12/139,269
  misc_feature (1)..(250): Public GI no. 33309864
  misc_feature (1)..(250): Utility: Useful for making larger plants
  misc_feature (1)..(250): Utility: Useful for making plants that flower early
  misc_feature (1)..(250): Utility: Useful for making plants with increased biomass
  misc_feature (1)..(250): Utility: Useful for making plants with increased biomass and foliage
  misc_feature (1)..(250): Utility: Useful for making smaller plants
MGRGRVQLRRIENKINRQVTFSKRRSGLLKKAHEISVLCDAEVALIIFSTKGKLYEYATDSCMERILERYERYTYAEKALISSGPELQGNWCHEFGKLKAKVEALQKSQRHLMGEQLEPLNLKELQQLEQQLESSLKHIRTRKCQLMFESISELQKKEKSLQEQNKMLEKELMEKQKVKALNQQAPWEQQGPPQTSSSSPTSFLIGDSLPTLNIGTYQCSGNEHGEEAAQPQVRIGNSLLPPWMLSHLNG

SEQ ID NO: 6957 - protein, 247 aa, Zea mays
  misc_feature (1)..(247): useful for making plants with modified plant phenotypes as described in USSN 12/139,269
  misc_feature (1)..(247): Public GI no. 6467974
  misc_feature (1)..(247): Utility: Useful for making larger plants
  misc_feature (1)..(247): Utility: Useful for making plants that flower early
  misc_feature (1)..(247): Utility: Useful for making plants with increased biomass
  misc_feature (1)..(247): Utility: Useful for making plants with increased biomass and foliage
  misc_feature (1)..(247): Utility: Useful for making smaller plants
MGRGRVQLKRIENKINRQVTFSKRRSGLLKKAHEISVLCDAEVALIVFSNKGKLYEYSTDSSMEKILERYERYSYAERALFSNEANPQADWRLEYNKLKARVESLQKSQRHLMGEQLDSLSIKELQRLEQQLESSLKFIRSRKTQLILHSISELQKMEKILLEQNKTLEKEIIAKEKAKALVQHAPWEKQNQSQYSSALPPVISDSVPTPTSRTFQARANEEESPQPQLRVSNTLLPPWMLSHMNGQ

SEQ ID NO: 6958 - protein, 244 aa, Zea mays
  misc_feature (1)..(244): useful for making plants with modified plant phenotypes as described in USSN 12/139,269
  misc_feature (1)..(244): Public GI no. 1483232
  misc_feature (1)..(244): Utility: Useful for making larger plants
  misc_feature (1)..(244): Utility: Useful for making plants that flower early
  misc_feature (1)..(244): Utility: Useful for making plants with increased biomass
  misc_feature (1)..(244): Utility: Useful for making plants with increased biomass and foliage
  misc_feature (1)..(244): Utility: Useful for making smaller plants
MGRGRVQLKRIENKINRQVTFSKRRSGLLKKAHEISVLCDAEVALIVFSTKGKLFEYSTDSCMERILERYERYSYADRQLLANDLEQNGSWTLEHAKLKARIEVLQRNQKHFVGEDLDSLSLKELQNLEQQLDSALKHIRSRKNQLMYESISELQRKDKALQEQNNVLAKKVKEKEKELAQQAQWEQQSHTLDSVPSLLPQPLQSSLNIGGSQQARGNGRVDEGTPPHRANALLPPWMLRHLNQ

SEQ ID NO: 6959 - protein, 250 aa, Zea mays
  misc_feature (1)..(250): useful for making plants with modified plant phenotypes as described in USSN 12/139,269
  misc_feature (1)..(250): Public GI no. 33355661
  misc_feature (1)..(250): Utility: Useful for making larger plants
  misc_feature (1)..(250): Utility: Useful for making plants that flower early
  misc_feature (1)..(250): Utility: Useful for making plants with increased biomass
  misc_feature (1)..(250): Utility: Useful for making plants with increased biomass and foliage
  misc_feature (1)..(250): Utility: Useful for making smaller plants
MGRGRVQLKRIENTINRQVTFSKRRAGLLKKANEISVLCDAEVALIIFSTKGKLSEYSTDARMESILERYDRYSSAERAIVAPDPDSQESWRDEYGRLKAKLEALQTSQRHLMGAQLDMLSVKELQQLEQQLENALKNIRTRKNQLMFDSISELQKKEKTLVSQNKDLEKKLIEKEKGKAMAQQGHWDQQGQQYTESSSPPSLLIQDPFPSLTIGINPASGSSEEDYEARPLPPANSNRLPPWMIRSANE

SEQ ID NO: 6960 - protein, 244 aa, Zea mays
  misc_feature (1)..(244): useful for making plants with modified plant phenotypes as described in USSN 12/139,269
  misc_feature (1)..(244): Public GI no. 30090030
  misc_feature (1)..(244): Utility: Useful for making larger plants
  misc_feature (1)..(244): Utility: Useful for making plants that flower early
  misc_feature (1)..(244): Utility: Useful for making plants with increased biomass
  misc_feature (1)..(244): Utility: Useful for making plants with increased biomass and foliage
  misc_feature (1)..(244): Utility: Useful for making smaller plants
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAHAAQQDQTQPQTSSSSSSFMLRDAPPAANTSIHPAAAGERAEDAAVQPQAPPRTGLPPWMVSHING

SEQ ID NO: 6961 - protein, 241 aa, Zea mays
  misc_feature (1)..(241): useful for making plants with modified plant phenotypes as described in USSN 12/139,269
  misc_feature (1)..(241): Public GI no. 32478105
  misc_feature (1)..(241): Utility: Useful for making larger plants
  misc_feature (1)..(241): Utility: Useful for making plants that flower early
  misc_feature (1)..(241): Utility: Useful for making plants with increased biomass
  misc_feature (1)..(241): Utility: Useful for making plants with increased biomass and foliage
  misc_feature (1)..(241): Utility: Useful for making smaller plants
  misc_feature (228)..(228): Xaa is any aa, unknown or other
VQLKRMENKINRQVTFSKRRGGLLKKAHEISILCDAEIALIIFSTKGKLYEYATNSKMDNILERYERYSYAEKALTSSDPDIQGNWCQEYAKLKSKVEALCKSQRHLMGEQLETLNLKELQQLEQQLEGSLKHVRSRKTQVMLDSISELQRKEKSLEEQNKNLEKEILEKQKIKALAQQAHWEHQNQPAPRGSPPRPFVIAESHPTLNIGHFQGRTNAVEAEENQQPXMRICSSLLPPWML

SEQ ID NO: 6962 - protein, 244 aa, Zea mays
  misc_feature (1)..(244): useful for making plants with modified plant phenotypes as described in USSN 12/139,269
  misc_feature (1)..(244): Public GI no. 33391153
  misc_feature (1)..(244): Utility: Useful for making larger plants
  misc_feature (1)..(244): Utility: Useful for making plants that flower early
  misc_feature (1)..(244): Utility: Useful for making plants with increased biomass
  misc_feature (1)..(244): Utility: Useful for making plants with increased biomass and foliage
  misc_feature (1)..(244): Utility: Useful for making smaller plants
MGRGRVELKRIENTINRQVTFSKRRGGLLKKANEISVLCDADVAIIIFSTKGKLSEYSTDARMESILERYDRYSCAERDIVAPDPDSQESWRDEYGRLKAKLEALQTSQRHLMGAQLDMLSAKELQQLEQQLENALKNIRSRKNQLLFDSISELLKKEKTLTTQNKDMEMKLIEKKKVKSMARQGQQYTESSSPPSLLIQDPFPSLTIGINPASGSSEEDNEARLLPPVNRNRLPPWMVRSANE

SEQ ID NO: 6963 - protein, 244 aa, Triticum aestivum
  misc_feature (1)..(244): useful for making plants with modified plant phenotypes as described in USSN 12/139,269
  misc_feature (1)..(244): Ceres CLONE ID no. 1314092
  misc_feature (1)..(244): Utility: Useful for making larger plants
  misc_feature (1)..(244): Utility: Useful for making plants that flower early
  misc_feature (1)..(244): Utility: Useful for making plants with increased biomass
  misc_feature (1)..(244): Utility: Useful for making plants with increased biomass and foliage
  misc_feature (1)..(244): Utility: Useful for making smaller plants
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAQAAQQDQTQPQTSSSSSSFMMRDAPPAAATSIHPAAAGERAGDAAVQPQAPPRTGLPLWMVSHING

SEQ ID NO: 6964 - protein, 244 aa, Triticum aestivum
  misc_feature (1)..(244): useful for making plants with modified plant phenotypes as described in USSN 12/139,269
  misc_feature (1)..(244): Public GI no. 39843110
  misc_feature (1)..(244): Utility: Useful for making larger plants
  misc_feature (1)..(244): Utility: Useful for making plants that flower early
  misc_feature (1)..(244): Utility: Useful for making plants with increased biomass
  misc_feature (1)..(244): Utility: Useful for making plants with increased biomass and foliage
  misc_feature (1)..(244): Utility: Useful for making smaller plants
MGRGKVQLKRIENKINRQVTFSKRRSGLLKKAHEISVLCDAEVGLIIFSTKGKLYEYATDSCMDKILERYERYSYAEKVLISAESETQGNWCHEYRKLKAKVETIQKCQKHLMGEDLESLNLKELQQLEQQLESSVKHIRSRKSQLMLESISELQKKEKSLQEENKVLQKELVEKQQVHKRLVQWDQTQPQTSSSSSSFMMREALPTTNISIYAAAAGERAEDAAGQPQIHIGLPPWMVSHING

SEQ ID NO: 6965 - DNA, 1267 bp, Glycine max
  misc_feature (1)..(1267): useful for making plants with modified plant phenotypes as described in USSN 12/139,269
  misc_feature (1)..(1267): Ceres CLONE ID no. 557009
  misc_feature (1)..(1267): Also known as  Ceres CDNA ID no. 23693452
  misc_feature (1068)..(1068): s is g or c
  misc_feature (1120)..(1120): s is g or c
  misc_feature (1124)..(1124): k is g or t/u
  misc_feature (1133)..(1133): s is g or c
  misc_feature (1163)..(1163): k is g or t/u
  misc_feature (1199)..(1199): r is g or a
  misc_feature (1221)..(1221): y is t/u or c
  misc_feature (1227)..(1227): y is t/u or c
  misc_feature (1254)..(1254): k is g or t/u
ggagtacacagtcaataacggtcacatgcgctttgctacttctctaaacgtgaaaacatttacaccaacctacactccttgctcctacatatcccgcgccttacatgcagttccaagtatcaccaaaccaagcagtgtgatactcatactcagtactcacagcaccactttcaagtgttcaaagttcaactatcccaatatcaacgaaccatggatacttgcaagaagtcccctttgaagccatggaagaaagggccaacaagggggaaaggcgggccccagaacgcctcctgcgagtaccgaggcgttcggcagcgaacttggggcaaatgggttgctgagataagagagccaaagaagagaaccaggctctggcttggttcttttgccacagctgaagaagctgccatggcttatgatgaggctgctaggagactctatggtccagatgcataccttaatctcccccacctgcaacccaggtccacttcaactatcacgtcaggaaagttcaaatggttcccttccaagaacttcatttcaatgtttccttcctgtggattactcaatgtaaatgctcaacctagtgttcatttaatccatcagaggctgcaagagcttaagcgaaattcagttgtgagtcaatcctcatctagttcatccaatgatccaaaggcagaaattcagaatgtagacagcaaaaatcacggagaagatgaaaatcctccaaaagatgttcaaacatcatcagaggaggtgcttggagatcttcaggagaaaccccagatagacctccatgagtttcttcaacagatgggaatacttaaagaagaaagacagtcagaaagaactgatagctcaggaagttcaacagtgcgtgaagctgtgttgacagatgactgtgatcatttgggagtgttttctgacaagagtgttaactgggaggcattgattgagatgcatggacttgcaggtattcaggaatcagaagtcactcagcttgaagcatatgagccaaatgatgatctaactttctcaacttccatttggaacttttaagaaacttascatataagcctaagcaatagatcacaaggttttggttatccaactactctastcckgtatatgtstgcagcatttcaatctgtcggcagcactgkaagagtaagaaagtagctagaatagaagactactartgagaaaggagcttatttcagyagttgygacagcaaatggagaaaataatatcaktctgcgtattatt

SEQ ID NO: 6966 - protein, 282 aa, Glycine max; identical to SEQ ID NO: 5337
  misc_feature (1)..(282): useful for making plants with modified plant phenotypes as described in USSN 12/139,269
  misc_feature (28)..(91): Pfam Name: AP2; Pfam Description: AP2 domain
  misc_feature (28)..(91): Pfam Name: AP2; Pfam Description: AP2 domain
  misc_feature (1)..(282): Utility: Useful for making larger plants
  misc_feature (1)..(282): Utility: Useful for making plants with altered leaf shape eg curled leaves
  misc_feature (1)..(282): Utility: Useful for making smaller plants

SEQ ID NO: 6967 - DNA, 1027 bp, Arabidopsis thaliana; identical to SEQ ID NO: 1686
  misc_feature (1)..(1027): useful for making plants with modified plant phenotypes as described in USSN 12/139,269
  misc_feature (1)..(1027): Ceres CLONE ID no. 96
  misc_feature (1)..(1027): Also known as  Ceres CDNA ID no. 23358923

SEQ ID NO: 6968 - protein, 246 aa, Arabidopsis thaliana; identical to SEQ ID NO: 1690
  misc_feature (1)..(246): useful for making plants with modified plant phenotypes as described in USSN 12/139,269
  misc_feature (1)..(246): Utility: Useful for making larger plants
  misc_feature (1)..(246): Utility: Useful for making ornamental plants with modified flowers
  misc_feature (1)..(246): Utility: Useful for making shorter plants and plants with modified flowers
  misc_feature (1)..(246): Utility: Useful for making stronger plants
  misc_feature (1)..(246): Utility: Useful for making taller plants and plants with longer inflorescences
  misc_feature (1)..(246): Utility: Useful for modifying plant structure, ie increased branching

SEQ ID NO: 6969 - DNA, 1309 bp, Arabidopsis thaliana
  misc_feature (1)..(1309): useful for making plants with modified plant phenotypes as described in USSN 12/139,269
  misc_feature (1)..(1309): Ceres CLONE ID no. 949
  misc_feature (1)..(1309): Also known as  Ceres CDNA ID no. 23359423
aaattacaatctctccttttgccaacaatcattgcttaaaaaacacataccttcttctttagttataaaaatgttgaaagaagagagtaatgagagtggtacttgggcacgagcatgtgacacttgtcgttcagccgcctgcactgtctactgtgaagccgactctgcctacttgtgcaccacctgtgatgctcgagttcacgcagccaaccgtgttgcttctcgccatgaacgtgttcgtgtctgtcagtcatgtgagtctgccccagctgcgtttttgtgtaaagcagacgctgcgtctctttgtacagcttgtgatgcagagattcattccgcaaacccactagctagacgtcatcagcgagttccgattcttccattatctgcaaactcttgcagctccatggccccaagtgagactgatgctgataacgatgaggatgatcgagaggttgcttcgtggttactccctaatccagggaaaaacatcggtaatcagaataatgggttcttgtttggtgttgagtaccttgatcttgtggattacagctccagcatggacaaccaattcgaagataatcagtacactcactaccagaggagctttggaggagatggagttgtgccgcttcaagttgaagaatcaacaagtcacctgcaacaaagccaacaaaactttcagttgggtatcaactatggattctcctcaggagctcactacaacaacaactccttaaaggacctaaaccatagcgcatccgtttcatcaatggacatcagtgttgtgccagagtcaactgcaagtgacataacagtccaacacccaagaactactaaagagacgatagaccaactatctggtcctcctactcaggtggtgcaacagcttactccaatggagagggaggctagggtcctgagatacagagagaagaagaagacaaggaaatttgacaagacaataagatatgcttcaagaaaggcatatgcagagataagaccacggatcaagggcagattcgcaaagaggatagaaactgaagctgaggctgaagaaatcttctcaacatcgctaatgtctgagactggatatggaattgttccttccttctaaactcctatggcgaagatggactagattgcatgctgtaaattacttctagtttggatttctacaagttattactgcatatgggtccttagttttgtgacttttgtctaactagtacgagtttaatcagatatgttcctatagctgcagttgtttaagcaacatctcgctacataattgaattggtgaaatcttatc

SEQ ID NO: 6970 - protein, 347 aa, Arabidopsis thaliana
  misc_feature (1)..(347): useful for making plants with modified plant phenotypes as described in USSN 12/139,269
  misc_feature (56)..(101): Pfam Name: zf-B_box; Pfam Description: B-box zinc finger
  misc_feature (284)..(322): Pfam Name: CCT; Pfam Description: CCT motif
  misc_feature (1)..(347): Utility: Useful for making larger plants
MLKEESNESGTWARACDTCRSAACTVYCEADSAYLCTTCDARVHAANRVASRHERVRVCQSCESAPAAFLCKADAASLCTACDAEIHSANPLARRHQRVPILPLSANSCSSMAPSETDADNDEDDREVASWLLPNPGKNIGNQNNGFLFGVEYLDLVDYSSSMDNQFEDNQYTHYQRSFGGDGVVPLQVEESTSHLQQSQQNFQLGINYGFSSGAHYNNNSLKDLNHSASVSSMDISVVPESTASDITVQHPRTTKETIDQLSGPPTQVVQQLTPMEREARVLRYREKKKTRKFDKTIRYASRKAYAEIRPRIKGRFAKRIETEAEAEEIFSTSLMSETGYGIVPSF

SEQ ID NO: 6971 - protein, 321 aa, Arabidopsis thaliana
  misc_feature (1)..(321): useful for making plants with modified plant phenotypes as described in USSN 12/139,269
  misc_feature (1)..(321): Public GI no. 40787165
  misc_feature (1)..(321): Utility: Useful for making larger plants
MLKEESNESGGTRACDTCRSAACTIYREADSTYLCTTCDARVHAAKRVRVCDSCESAPAAFFCKADAAPLCTACDAEIHSANPLARRHQRVPITSNSCGSMATDGDNNVMMVSEEKEDADEVASWLMLNPGKNNQNNGFLFGVEYLDLVDYSSSIDNQFEDQYNHYQRSFGGGEDGVVPLQLEESTSHMQQSQHNFHLGVNYGFSTEPHYSYISVVPESTSSDTTVQHAKETMDQVSGPPTQMVQQLTPADREARVLRYREKKKRRKFEKTIRYASRKAYAEVRPRIKGRFAKRIDMEADAEQLFSTSLMSNTSYGIVPSF

SEQ ID NO: 6972 - protein, 321 aa, Arabidopsis thaliana; identical to SEQ ID NO: 4903
  misc_feature (1)..(321): useful for making plants with modified plant phenotypes as described in USSN 12/139,269
  misc_feature (1)..(321): Public GI no. 33943521
  misc_feature (1)..(321): Utility: Useful for making larger plants

SEQ ID NO: 6973 - protein, 342 aa, Arabidopsis thaliana
  misc_feature (1)..(342): useful for making plants with modified plant phenotypes as described in USSN 12/139,269
  misc_feature (1)..(342): Public GI no. 22854966
  misc_feature (1)..(342): Utility: Useful for making larger plants
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDANHALSTMVMSDTGYGIVPSFS

SEQ ID NO: 6974 - protein, 345 aa, Arabidopsis thaliana
  misc_feature (1)..(345): useful for making plants with modified plant phenotypes as described in USSN 12/139,269
  misc_feature (1)..(345): Public GI no. 22854942
  misc_feature (1)..(345): Utility: Useful for making larger plants
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNNSENNRFSVGEEYLDLVDYSSSMDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYGIVPSFS

SEQ ID NO: 6975 - protein, 342 aa, Arabidopsis thaliana
  misc_feature (1)..(342): useful for making plants with modified plant phenotypes as described in USSN 12/139,269
  misc_feature (1)..(342): Public GI no. 22854970
  misc_feature (1)..(342): Utility: Useful for making larger plants
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 6976 - protein, 342 aa, Arabidopsis thaliana
  misc_feature (1)..(342): useful for making plants with modified plant phenotypes as described in USSN 12/139,269
  misc_feature (1)..(342): Public GI no. 22854950
  misc_feature (1)..(342): Utility: Useful for making larger plants
  misc_feature (177)..(177): Xaa is any aa, unknown or other
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFXGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 6977 - protein, 348 aa, Arabidopsis thaliana
  misc_feature (1)..(348): useful for making plants with modified plant phenotypes as described in USSN 12/139,269
  misc_feature (1)..(348): Public GI no. 22854918
  misc_feature (1)..(348): Utility: Useful for making larger plants
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTGYGIVPSFS

SEQ ID NO: 6978 - protein, 345 aa, Arabidopsis thaliana
  misc_feature (1)..(345): useful for making plants with modified plant phenotypes as described in USSN 12/139,269
  misc_feature (1)..(345): Public GI no. 22854982
  misc_feature (1)..(345): Utility: Useful for making larger plants
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 6979 - protein, 348 aa, Arabidopsis thaliana
  misc_feature (1)..(348): useful for making plants with modified plant phenotypes as described in USSN 12/139,269
  misc_feature (1)..(348): Public GI no. 22854908
  misc_feature (1)..(348): Utility: Useful for making larger plants
  misc_feature (321)..(321): Xaa is any aa, unknown or other
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAXRNEVDADQAFPTVVMFDTGYGIVPSFS

SEQ ID NO: 6980 - protein, 348 aa, Arabidopsis thaliana
  misc_feature (1)..(348): useful for making plants with modified plant phenotypes as described in USSN 12/139,269
  misc_feature (1)..(348): Public GI no. 22854910
  misc_feature (1)..(348): Utility: Useful for making larger plants
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTRYGIVPSFS

SEQ ID NO: 6981 - protein, 345 aa, Arabidopsis thaliana
  misc_feature (1)..(345): useful for making plants with modified plant phenotypes as described in USSN 12/139,269
  misc_feature (1)..(345): Public GI no. 22854934
  misc_feature (1)..(345): Utility: Useful for making larger plants
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADQALSTMVVFDTGYGIVPSFS

SEQ ID NO: 6982 - protein, 348 aa, Arabidopsis thaliana
  misc_feature (1)..(348): useful for making plants with modified plant phenotypes as described in USSN 12/139,269
  misc_feature (1)..(348): Public GI no. 22854916
  misc_feature (1)..(348): Utility: Useful for making larger plants
MLKQESNWAQACDTCRSAACTVYCRADSAYLCTSCDAQIHAANRLASRHERVRVCESCERAPAVFFCQADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTGYGIVPSFS

SEQ ID NO: 6983 - DNA, 886 bp, Arabidopsis thaliana
  misc_feature (1)..(886): useful for making plants with modified plant phenotypes as described in USSN 12/139,269
  misc_feature (1)..(886): Ceres CLONE ID no. 2036
  misc_feature (1)..(886): Also known as  Ceres CDNA ID no. 23427576
aaaaagaagctatggcttccaatttctggacttcgacgcactacaaagagcttaaggacccagaagaggttaatgttgttcatcctcttgatgctcagagaggaatctctgttgaagatttcagactcattaagcttcatatgtctaattatatatcgaaactggcacaacacattaagattaggcaaagagttgttgcaactgcagtaacctatatgcgtcgtgtttacacaagaaagagtttgacggaatatgagcctcggcttgttgctcctacatgcttgtatttggcttgcaaagcagaagagagtgtggtgcatgccaaacttcttgtcttctacatgaaaaaactttatgcggatgaaaagtttcgatatgagattaaagatattctggaaatggagatgaaggtcttggaagcattgaacttctatcttgttgtattccacccatatcgatctctgcctgagttcttgcaggattctggaatcaatgacactagtatgacccatctaacttggggtcttgtcaacgacacatatagaatggacctcatccttatacatccgccgtttctcataacactcgcttgcatttacattgcttctgtacacaaagagaaagacataaagacatggtttgaagagctttctgtcgacatgaacattgtgaagaatattgcaatggagatattagatttctatgaaaaccatagactgttcacggaagagagagttcacgccgccttcaacaaacttgctacaaacccataaagtttcgacttgtctgtgtgttttgttcccttgagaaaatataatgttttgccagaagttttggaaatgagattattctgtttattgtacatcagttttgctcgtcttggttc

SEQ ID NO: 6984 - protein, 253 aa, Arabidopsis thaliana
  misc_feature (1)..(253): useful for making plants with modified plant phenotypes as described in USSN 12/139,269
  misc_feature (9)..(143): Pfam Name: Cyclin_N; Pfam Description: Cyclin, N-terminal domain
  misc_feature (1)..(253): Utility: Useful for making larger plants
  misc_feature (1)..(253): Utility: Useful for making ornamental plants with modified flowers
  misc_feature (1)..(253): Utility: Useful for making plants sterile and for genetic confinement
MASNFWTSTHYKELKDPEEVNVVHPLDAQRGISVEDFRLIKLHMSNYISKLAQHIKIRQRVVATAVTYMRRVYTRKSLTEYEPRLVAPTCLYLACKAEESVVHAKLLVFYMKKLYADEKFRYEIKDILEMEMKVLEALNFYLVVFHPYRSLPEFLQDSGINDTSMTHLTWGLVNDTYRMDLILIHPPFLITLACIYIASVHKEKDIKTWFEELSVDMNIVKNIAMEILDFYENHRLFTEERVHAAFNKLATNP

SEQ ID NO: 6985 - protein, 212 aa, Glycine max
  misc_feature (1)..(212): useful for making plants with modified plant phenotypes as described in USSN 12/139,269
  misc_feature (1)..(212): Ceres CLONE ID no. 463096
  misc_feature (1)..(212): Utility: Useful for making larger plants
  misc_feature (1)..(212): Utility: Useful for making ornamental plants with modified flowers
  misc_feature (1)..(212): Utility: Useful for making plants sterile and for genetic confinement
  misc_feature (88)..(88): Xaa is any aa, unknown or other
MHMANYILKLAQQVKVRQRVVATAVTYMRRVYTRKSMAEYDPRLVAPTCLYLASKAEESTVQARLLVFYIKKLYSDDKYRYEIKDILXMEMKILEALNYYLVVYHPYRSLVPLLQDAGLNDLNMTQLTWGLVNDTYKMDLILVHPPHLIALACIYIASVLREKDTTAWFEELRVDMNVVKNISMEILDFYESNRMFTDERINAALQKLSLRP

SEQ ID NO: 6986 - protein, 253 aa, Glycine max
  misc_feature (1)..(253): useful for making plants with modified plant phenotypes as described in USSN 12/139,269
  misc_feature (1)..(253): Public GI no. 42568400
  misc_feature (1)..(253): Utility: Useful for making larger plants
  misc_feature (1)..(253): Utility: Useful for making ornamental plants with modified flowers
  misc_feature (1)..(253): Utility: Useful for making plants sterile and for genetic confinement
MAANFWNSSHYKQLLDPEEVDVVHDLDKERGISIDDFKLIKFHMSNHIMKLAQHIKVRQRVVATAITYMRRVYIRKSMVEFEPRLVALTCLYLASKAEESIVQARNLVFYIKRLYPDEYNKYELKDILGMEMKVLEALDYYLVVFHPYRSLSEFLQDAALNDVNMNQITWGIVNDTYKMDLILVHPPYRIALACIYIASVHREKDITAWFEDLHEDMNLVKNIAMEILDFYENYRTITEEKVNSAFSKLALKL

SEQ ID NO: 6987 - protein, 259 aa, Glycine max
  misc_feature (1)..(259): useful for making plants with modified plant phenotypes as described in USSN 12/139,269
  misc_feature (1)..(259): Public GI no. 10177354
  misc_feature (1)..(259): Utility: Useful for making larger plants
  misc_feature (1)..(259): Utility: Useful for making ornamental plants with modified flowers
  misc_feature (1)..(259): Utility: Useful for making plants sterile and for genetic confinement
MAANFWNSSHYKQLLDPEEVDVVHDLDKERGISIDDFKLIKFHMSNHIMKLAQHIKVRQRVVATAITYMRRVYIRKSMVEFEPRLVALTCLYLASKAEESIVQARNLVFYIKRLCNIFFFYPDEYNKYELKDILGMEMKVLEALDYYLVVFHPYRSLSEFLQDAALNDVNMNQITWGIVNDTYKMDLILVHPPYRIALACIYIASVHREKDITAWFEDLHEDMNLVKNIAMEILDFYENYRTITEEKVNSAFSKLALKL

SEQ ID NO: 6988 - protein, 257 aa, Glycine max
  misc_feature (1)..(257): useful for making plants with modified plant phenotypes as described in USSN 12/139,269
  misc_feature (1)..(257): Public GI no. 7489457
  misc_feature (1)..(257): Utility: Useful for making larger plants
  misc_feature (1)..(257): Utility: Useful for making ornamental plants with modified flowers
  misc_feature (1)..(257): Utility: Useful for making plants sterile and for genetic confinement
MAANFWTSSHCKQLLDQEDVDKVPQADSDRGITLEEFRLVKIHMSFHIWRLAQQVKVRQRVIATAVTYFRRVYTRKSMTEYDPRLVAPTCLYLASKVEESTVQARLLVFYIKKMCASDEKYRFEIKDILEMEMKLLEALDYYLVVYHPYRPLLQLLQDAGITDLTQFAWGIVNDTYKMDLILIHPPYMIALACIYIASVLKDKDITLWFEELRVDMNIVKNISMEILDFYDTYKIDPQRGLPEDKIAPVMNKLPSKA

SEQ ID NO: 6989 - protein, 257 aa, Zea mays
  misc_feature (1)..(257): useful for making plants with modified plant phenotypes as described in USSN 12/139,269
  misc_feature (1)..(257): Ceres CLONE ID no. 385771
  misc_feature (1)..(257): Utility: Useful for making larger plants
  misc_feature (1)..(257): Utility: Useful for making ornamental plants with modified flowers
  misc_feature (1)..(257): Utility: Useful for making plants sterile and for genetic confinement
MAANFWTSSHCKQLLDPEDVDLVPAADRERGITPEEFRLIKIHMSFHIWRLAQQVKVRQRVVATAISYFRRVYTRKSMSDYDPRLVAPTCLYLASKVEESTVQARLLVFYIKKMCGSDDKYRFEIKDILEMEMKLLEALDYYLVVFHPYRPLLQLLQDAGITDLTQFAWGLVNDTYKMDLILIYPPYMIALACIYIASVLKDKDTTAWFEELRVDMNIVKNISMEILDFYDTYKIDPQRGIPEDKISPVMNKLPAKA

SEQ ID NO: 6990 - protein, 258 aa, Triticum aestivum
  misc_feature (1)..(258): useful for making plants with modified plant phenotypes as described in USSN 12/139,269
  misc_feature (1)..(258): Ceres CLONE ID no. 729756
  misc_feature (1)..(258): Utility: Useful for making larger plants
  misc_feature (1)..(258): Utility: Useful for making ornamental plants with modified flowers
  misc_feature (1)..(258): Utility: Useful for making plants sterile and for genetic confinement
MAANFWASSHSKQLLDPEDVDVVPAADRERGITTEEFRLVKIHMSSHIWRLAQQVKVRQRVIATAITYFRRVYTRKSMSEYDPRLVAPACLYLASKVEESTVQARLLVFYIKKMCAGSDDKYRFEIKDILEMEMKLLEALDYYLVVYHPYRPLLHLLQDAGVTDLTQFAWGLVNDTYKMDLILVQPPYMIALACIYIASVLKDKDTTSWFEELHVDMNIVKNISMEILDFYETYKVDPQRGLSDEKISPIMNKLPAKA

SEQ ID NO: 6991 - protein, 257 aa, Triticum aestivum
  misc_feature (1)..(257): useful for making plants with modified plant phenotypes as described in USSN 12/139,269
  misc_feature (1)..(257): Ceres CLONE ID no. 615259
  misc_feature (1)..(257): Utility: Useful for making larger plants
  misc_feature (1)..(257): Utility: Useful for making ornamental plants with modified flowers
  misc_feature (1)..(257): Utility: Useful for making plants sterile and for genetic confinement
MAANFWTSSHSKQLLDPEEVDVVPAQDRERGVTPVEFRLVKIHMSFHIWRLAQQVKVRQRVIATAITYFRCVYTRKSMTEYDPRLVAPACLYLASKVEESTVQARLLVFYIKKMCGSDDKYRFEIKDILEMEMKLLEALDYYLVVYHPYRPLLQLLQDAGITDLTQFAWGLVNDTYKMDLILIYPPYMIALACIYIASVLKDKDTTSWFEELRVDMNIVKNISMEILDFYDTYKIDPQRGLQEDKIIPVMNKLPSKA

SEQ ID NO: 6992 - DNA, 1371 bp, Arabidopsis thaliana
  misc_feature (1)..(1371): useful for making plants with modified plant phenotypes as described in USSN 12/139,269
  misc_feature (1)..(1371): Ceres CLONE ID no. 18857
  misc_feature (1)..(1371): Also known as  Ceres CDNA ID no. 23527182
gacgagacattgaaaactcccatctaccttttctctttctctctctctccctcccaaagtcgaacctgcaatccctaaatccccaatttgagaccatctccagttcgtcatcgtacgacgactctctctctctctctcctcttctctgtatagtcgaattatattacaagttagatagatagcatgaattggttacctgaagctgaagctgaggatgacttcaaaggtcttctctctggtgatttctttgatgatctcatcaatcaccttgacgtccctcttgatgacattgataccaccaatggtgaaggagattgggttgacaggtttcaagaccttgagcctcctcccatggatatgttccccactttgccttctgacctcacctcttgcggctctggcatggccaaggcccctcgtgtggatattcaaaggaacattcctgctttgaaacagtcctattcttctgaagccttgtccagcactctccaccaatcttcagctcctcctgaaatcaaagtttcgaaactatttcagtctttaagtccagtgtcagttctcgagaacagttatggttctctctcgacccacaacaatggatctcagagattggctttccctgtgaaaggcatgagaagcaagcgcaaacgccccacaacactgagacttagctaccttttcccctctgaaccccgaaagcccgagaagtcaaccccgggcaaacctgaatccgagtgttacttttcttctgagcaacatgccaagaagaaacgcaagatccacctgaccacccgcacggtctcttccactctggaggcaagcaactcggatgggatagtccgcaaatgcactcattgcgagacaaccaagaccccacagtggagggaaggacccagtggaccgaagaccctctgcaatgcttgcggagtgaggttcagatctggtcgcctagttccagaataccgaccagcctcaagccccaccttcatcccagctgtgcattcaaactcacacaggaagatcattgagatgagaaggaaggacgacgaacagtttgatagcagcatgattcgggcagtgatatccagagggtaaagcagttttttttttaaagtttggtctctgatccgcagaaatgggaagtcagtggaggaagaagatggtataaaagtagggtttagtgactgttttcaaatctgatgaagagagtttagtggtttagttcaagttagggatatgaaatattttgttgtttcattatgtgtttttatctttatctcttggctgacatttgtgtatcagaggaaaacaggtgaagccaaagtttgctctctttttttcgctatttcaaatctattctttttattcttc

SEQ ID NO: 6993 - protein, 303 aa, Arabidopsis thaliana
  misc_feature (1)..(303): useful for making plants with modified plant phenotypes as described in USSN 12/139,269
  misc_feature (222)..(257): Pfam Name: GATA; Pfam Description: GATA zinc finger
  misc_feature (1)..(303): Utility: Useful for making larger plants
MNWLPEAEAEDDFKGLLSGDFFDDLINHLDVPLDDIDTTNGEGDWVDRFQDLEPPPMDMFPTLPSDLTSCGSGMAKAPRVDIQRNIPALKQSYSSEALSSTLHQSSAPPEIKVSKLFQSLSPVSVLENSYGSLSTHNNGSQRLAFPVKGMRSKRKRPTTLRLSYLFPSEPRKPEKSTPGKPESECYFSSEQHAKKKRKIHLTTRTVSSTLEASNSDGIVRKCTHCETTKTPQWREGPSGPKTLCNACGVRFRSGRLVPEYRPASSPTFIPAVHSNSHRKIIEMRRKDDEQFDSSMIRAVISRG

SEQ ID NO: 6994 - protein, 250 aa, Arabidopsis thaliana; identical to SEQ ID NO: 6096
  misc_feature (1)..(250): useful for making plants with modified plant phenotypes as described in USSN 12/139,269
  misc_feature (1)..(250): Ceres CLONE ID no. 1334990
  misc_feature (1)..(250): Utility: Useful for making larger plants

SEQ ID NO: 6995 - protein, 308 aa, Arabidopsis thaliana
  misc_feature (1)..(308): useful for making plants with modified plant phenotypes as described in USSN 12/139,269
  misc_feature (1)..(308): Public GI no. 20466045
  misc_feature (1)..(308): Utility: Useful for making larger plants
MNWLPEAEAEEHLKGILSGDFFDGLTNHLDCPLEDIDSTNGEGDWVARFQDLEPPPLDMFPALPSDLTSCPKGAARVRIPNNMIPALKQSCSSEALSGINSTPHQSSAPPDIKVSYLFQSLTPVSVLENSYGSLSTQNSGSQRLAFPVKGMRSKRRRPTTVRLSYLFPFEPRKSTPGESVTEGYYSSEQHAKKKRKIHLITHTESSTLESSKSDGIVRICTHCETITTPQWRQGPSGPKTLCNACGVRFKSGRLVPEYRPASSPTFIPSVHSNSHRKIIEMRKKDDEFDTSMIRSDIQKVKQGRKKMV

SEQ ID NO: 6996 - protein, 389 aa, Triticum aestivum
  misc_feature (1)..(389): useful for making plants with modified plant phenotypes as described in USSN 12/139,269
  misc_feature (1)..(389): Ceres CLONE ID no. 938230
  misc_feature (1)..(389): Utility: Useful for making larger plants
MEATAPDYYARDKKGSDLFVVDDLLALPCDDEEEEEEGVGDAPFLPANAASAAAVVVKQEAGFGNASADSSTVTALDSCSNSFSGLADGDFSGGLCEPYDQLAELEWLSNYMGEGEESFATEDLHKLQLISGIPSGGFPSANGPPAPAATAATAQPGVFLPEGPVPAKARSKRSRVAPGNWSSRLLVLPPAPASPPSPASMAISPAESGVSAQAFHVKKPSKPAKKKEVPPQAQAQAQTQSVSAPTAPSGVTAAANEGRRCLHCETDKTPQWRTGPMGPKTLCNACGVRYKSGRLVPEYRPAASPTFVTSRHSNSHRKVLELRRQREMHHHHQPSQLQQHAVAGGVGRIMHMESHLLFDGPAAPPILGGGDDFLIHHRLGTADYRQQLI

SEQ ID NO: 6997 - protein, 386 aa, Triticum aestivum
  misc_feature (1)..(386): useful for making plants with modified plant phenotypes as described in USSN 12/139,269
  misc_feature (1)..(386): Public GI no. 52353703
  misc_feature (1)..(386): Utility: Useful for making larger plants
MEVAAADYAGGVRVKKEAGGCGGSGDMFLVDDLLDLPCDEEEEETGLCGAYGGGGAGLGAGVVGGGGDDRAAGNASADSSTVTAVDSCSNSFSGLADGDFSGGLCEPYEQLAELEWVSTYMGEETLPTEDLRKLQLISGIPAAPRAPPALAVSAVQLPAGGAGALPTEAPVPGKARSKRSRVAPCSWSSRLMVLPPPPASPPSPASAVISPSESGTAAPAFPAKKAAKSAKKKDGPSPAPAPNAAAQAAAEGRRCLHCETDKTPQWRTGPMGPKTLCNACGVRYKSGRLVPEYRPAASPTFVVSKHSNSHRKVVELRRQKEMQLLHHHQQPPPHVGAGGGGAAGGLLHVTSPLLFDGPTSSAPLFAGADEFLIHNRISPDYRRQAT

SEQ ID NO: 6998 - protein, 305 aa, Triticum aestivum
  misc_feature (1)..(305): useful for making plants with modified plant phenotypes as described in USSN 12/139,269
  misc_feature (1)..(305): Public GI no. 12711287
  misc_feature (1)..(305): Utility: Useful for making larger plants
MMTMVGHCGYLDGIPTGPVVDEDFDDILNFLDFPLESLEEDGQGVEWDASESKFLGPIPMDALMAFPPVPQGNIGNGRVKAEPNSNHPIKVTEGQGSGIFQTQSPVSVLESSNSCSGGKSISIKHDIAIPVRPRSKRPRSSALNPWILMPPISSTRFASKKTCDARKGKEKKRKMSLLSVPQIADVTKKKTTSGQQFSFKKCTHCQVTKTPQWREGPLGPKTLCNACGVRYRSGRLFPEYRPAASPTFVPTLHSNSHRKVVEMRKKAIYGETSALEEPHNVIVEGPPMSPAPEFVPMSSYLFDVY

SEQ ID NO: 6999 - protein, 295 aa, Zea mays
  misc_feature (1)..(295): useful for making plants with modified plant phenotypes as described in USSN 12/139,269
  misc_feature (1)..(295): Ceres CLONE ID no. 305252
  misc_feature (1)..(295): Utility: Useful for making larger plants
MAQLEWLSGLFDDASIPHEPAFPGAAPIIKSSALAAGALLPPDKMGDALLFRSSSPISVLEHGSFNNANGGGGGCSASSESSSASSSSESFSGSGSGEGHAWSAPVSPPPVLVIPARARSKRSRPSAFTRAGAEAPTILVPTPMYSSGPSHSDPESIAESSPHPAPPMKKKKKAKKPPAPPAPASSDDNDGDADYEEGGERTEPQGCAVRRCTHCQIEKTPQWRAGPLGPKTLCNACGVRYKSGRLFPEYRPAASPTFVPSIHSNSHKKVVEMRQKAVRSGDPSCDLLQFIRRRD

SEQ ID NO: 7000 - protein, 283 aa, Glycine max
  misc_feature (1)..(283): useful for making plants with modified plant phenotypes as described in USSN 12/139,269
  misc_feature (1)..(283): Ceres CLONE ID no. 473814
  misc_feature (1)..(283): Utility: Useful for making larger plants
MDMELLDLPLDFEDVETDAVEEQDWDAQLKLLEDPPPPLGVFPLQQSSAFCGQTRNENAKLGSKSFSASLAKTVRPAYGKTIPVQKVSLKGKDLLQFQTNSPVSVFESSSSSPSVENSNFELPVIPTKRPRTKRRRLSNISLLYSIPFILTSPAFQKFQRMDFSKSDIQTQPSGELLCKFKKKQRKKDIPLPTNKIEMKRSSSQESVAPRKCLHCEVTKTPQWREGPMGPKTLCNACGVRYRSGRLFAEYRPASSPTFVASLHSNSHKKVLEIRNRATQVTVR

SEQ ID NO: 7001 - DNA, 872 bp, Arabidopsis thaliana
  misc_feature (1)..(872): useful for making plants with modified plant phenotypes as described in USSN 12/139,269
  misc_feature (1)..(872): Ceres CLONE ID no. 23518
  misc_feature (1)..(872): Also known as  Ceres CDNA ID no. 23649747
atcgaacattaaaacctgattttactgaaactgtgctgcgaaggagaagccgcaaaccattttttgtcaatctagggttcttcttcgtacttgcagatttcgcctccgttttcactacgatctgtgaagatgttctccgctcagaacaagatcaataaggacaagaatgctgagccaacagaatgcgaggagcaagttgctcaggctttgtttgatttggagaacactaaccaggagttgaaaagcgagttgaaagatctctacatcaaccaagctgttcacatggatatctctggaaaccgcaaagctgttgtgatttacgttccattcagattgaggaaagctttccgcaagattcatccccgtctcgtcagagagcttgagaagaagttcagtggaaaggatgttatctttgttaccacaagaaggatcatgcgtccccccaagaagggtgctgctgttcagaggccacgtaacagaactcttacctcagttcatgaagctatgcttgaagatgttgctttccccgctgagattgttggaaagcgtactcgctaccgtcttgatggttccaagatcatgaaggtctttttggatgccaaggaaaagaacaacacagagtacaagctcgagactatggtcggtgtgtaccgtaaacttactggcaaagatgttgtttttgagtacccagtcgaagcttgaaagaagatgatgaagaaccatcaggatagtgaaagagagcttttgtttatgttttgtggtatttaggatgaaggaaactctcttgattcagttccttgttcacaatctttaatgttctatttacaatgactactttttgtgtttttcaattttgaaacctctatgatttc

SEQ ID NO: 7002 - protein, 190 aa, Arabidopsis thaliana
  misc_feature (1)..(190): useful for making plants with modified plant phenotypes as described in USSN 12/139,269
  misc_feature (4)..(189): Pfam Name: Ribosomal_S7e; Pfam Description: Ribosomal protein S7e
  misc_feature (1)..(190): Utility: Useful for making larger plants
  misc_feature (1)..(190): Utility: Useful for making plants with increased biomass and foliage
  misc_feature (1)..(190): Utility: Useful for making smaller plants
MFSAQNKINKDKNAEPTECEEQVAQALFDLENTNQELKSELKDLYINQAVHMDISGNRKAVVIYVPFRLRKAFRKIHPRLVRELEKKFSGKDVIFVTTRRIMRPPKKGAAVQRPRNRTLTSVHEAMLEDVAFPAEIVGKRTRYRLDGSKIMKVFLDAKEKNNTEYKLETMVGVYRKLTGKDVVFEYPVEA

SEQ ID NO: 7003 - protein, 190 aa, Brassica napus
  misc_feature (1)..(190): useful for making plants with modified plant phenotypes as described in USSN 12/139,269
  misc_feature (1)..(190): Ceres CLONE ID no. 1070069
  misc_feature (1)..(190): Utility: Useful for making larger plants
  misc_feature (1)..(190): Utility: Useful for making plants with increased biomass and foliage
  misc_feature (1)..(190): Utility: Useful for making smaller plants
  misc_feature (119)..(119): Xaa is any aa, unknown or other
  misc_feature (163)..(163): Xaa is any aa, unknown or other
MFSAQNKIKKDKNAEPTECDVQVAQALFDLENTNQELKSELKDLYINQAVNMDICGNRKAIVIYVPFRLRKAFRKIHPRLVRELEKKFSGKDVIFVATRRIMRPPKKGAAVQRPRNRTXTSVHEAMLEDVAYPAEIVGKRTRYRLDGSKVMKVYLEAKERNNXEYKLETMVGVYRKLTGKDVTFEYPVEA

SEQ ID NO: 7004 - protein, 191 aa, Arabidopsis thaliana
  misc_feature (1)..(191): useful for making plants with modified plant phenotypes as described in USSN 12/139,269
  misc_feature (1)..(191): Ceres CLONE ID no. 20681
  misc_feature (1)..(191): Utility: Useful for making larger plants
  misc_feature (1)..(191): Utility: Useful for making plants with increased biomass and foliage
  misc_feature (1)..(191): Utility: Useful for making smaller plants
MYSGQNKIHKDKGVAPTEFEEQVTQALFDLENTNQELKSELKDLYINQAVQMDISGNRKAVVIYVPFRLRKAFRKIHLRLVRELEKKFSGKDVIFVATRRIMRPPKKGSAVQRPRNRTLTSVHEAMLEDVAYPAEIVGKRTRYRLDGTKIMKVFLDSKLKNDTEYKLETMVGVYRKLTGKDVVFEYPVIEA

SEQ ID NO: 7005 - protein, 191 aa, Arabidopsis thaliana; identical to SEQ ID NO: 7004
  misc_feature (1)..(191): useful for making plants with modified plant phenotypes as described in USSN 12/139,269
  misc_feature (1)..(191): Public GI no. 6957719
  misc_feature (1)..(191): Utility: Useful for making larger plants
  misc_feature (1)..(191): Utility: Useful for making plants with increased biomass and foliage
  misc_feature (1)..(191): Utility: Useful for making smaller plants

SEQ ID NO: 7006 - protein, 191 aa, Arabidopsis thaliana
  misc_feature (1)..(191): useful for making plants with modified plant phenotypes as described in USSN 12/139,269
  misc_feature (1)..(191): Public GI no. 5532505
  misc_feature (1)..(191): Utility: Useful for making larger plants
  misc_feature (1)..(191): Utility: Useful for making plants with increased biomass and foliage
  misc_feature (1)..(191): Utility: Useful for making smaller plants
MFSAQNKIHKDKGVAPTEFEERVAQAFFDLENTNQELKSDLKDLYINQAVSMDIAGNRKAVVIYVPFRLRKAFRKIHSRLVRELEKKFSGNDVIFVATRRIMRPPKKGSAVQRPRNRTLTSVHEAMLEDVAYPAEIVGKRTRYRVDGTKIMKVYLEPKERNNTEYKLETMVGVYRKLTGKDVVFEYPVADP

SEQ ID NO: 7007 - protein, 191 aa, Glycine max
  misc_feature (1)..(191): useful for making plants with modified plant phenotypes as described in USSN 12/139,269
  misc_feature (1)..(191): Ceres CLONE ID no. 553599
  misc_feature (1)..(191): Utility: Useful for making larger plants
  misc_feature (1)..(191): Utility: Useful for making plants with increased biomass and foliage
  misc_feature (1)..(191): Utility: Useful for making smaller plants
  misc_feature (143)..(143): Xaa is any aa, unknown or other
  misc_feature (171)..(171): Xaa is any aa, unknown or other
MYTSRKKIHKDKDAEPTEFEETVAQYLFDLENTNQDLKSDLKDLYINQAIQMDVAGNRKAVVIYVPFRLRKAFRKIHLRLVRELEKKFSGKDVVFIATRRIVRPPKKGSAVQRPRTRTLTAVHDAMLEDVVYPAEIVGKRVRXRIDGSKIMKVFLDPKERNNTEYKLETFXGVYRKLTGKDVVFEYPISEA

SEQ ID NO: 7008 - protein, 191 aa, Glycine max
  misc_feature (1)..(191): useful for making plants with modified plant phenotypes as described in USSN 12/139,269
  misc_feature (1)..(191): Ceres CLONE ID no. 1113804
  misc_feature (1)..(191): Utility: Useful for making larger plants
  misc_feature (1)..(191): Utility: Useful for making plants with increased biomass and foliage
  misc_feature (1)..(191): Utility: Useful for making smaller plants
MYTSRKKIHKDKDAEPTEFEETVGQYLFDLENTNQDLKSDLKDLYINQAIQMDVAGNRKAVVIYVPFRLRKAFRKIHLRLVRELEKKFSGKDVVLIATRRIVRPPKKGSAVQRPRTRTLTAVHDAMLEDVVYPAEIVGKRARYRIDGSKIMKVFLDPKERNNTEYKLETFSGVYRKLTGKDVVFEYPISEA

SEQ ID NO: 7009 - protein, 191 aa, Glycine max
  misc_feature (1)..(191): useful for making plants with modified plant phenotypes as described in USSN 12/139,269
  misc_feature (1)..(191): Ceres CLONE ID no. 479777
  misc_feature (1)..(191): Utility: Useful for making larger plants
  misc_feature (1)..(191): Utility: Useful for making plants with increased biomass and foliage
  misc_feature (1)..(191): Utility: Useful for making smaller plants
MYTSRKKIHKDKDAEPTEFEESVGQALFDLENTNQELKSDLKDLYINSAVQVDVSGNRKAVVIHVPYRLRKGFRKIHVRLVRELEKKFSGKDVILVATRRILRPPKKGSAAQRPRSRTLTAVHEAMLEDVVLPAEIVGKRVRFRIDGSKIMKVYLDPKERNNTEYKLETFAAVYRKLSGKDVVFEYPVSEA

SEQ ID NO: 7010 - protein, 191 aa, Brassica napus
  misc_feature (1)..(191): useful for making plants with modified plant phenotypes as described in USSN 12/139,269
  misc_feature (1)..(191): Ceres CLONE ID no. 1066903
  misc_feature (1)..(191): Utility: Useful for making larger plants
  misc_feature (1)..(191): Utility: Useful for making plants with increased biomass and foliage
  misc_feature (1)..(191): Utility: Useful for making smaller plants
  misc_feature (99)..(99): Xaa is any aa, unknown or other
  misc_feature (107)..(107): Xaa is any aa, unknown or other
  misc_feature (109)..(109): Xaa is any aa, unknown or other
  misc_feature (110)..(110): Xaa is any aa, unknown or other
  misc_feature (113)..(113): Xaa is any aa, unknown or other
  misc_feature (114)..(114): Xaa is any aa, unknown or other
  misc_feature (119)..(119): Xaa is any aa, unknown or other
  misc_feature (120)..(120): Xaa is any aa, unknown or other
  misc_feature (125)..(125): Xaa is any aa, unknown or other
  misc_feature (127)..(127): Xaa is any aa, unknown or other
  misc_feature (128)..(128): Xaa is any aa, unknown or other
  misc_feature (140)..(140): Xaa is any aa, unknown or other
  misc_feature (141)..(141): Xaa is any aa, unknown or other
  misc_feature (148)..(148): Xaa is any aa, unknown or other
  misc_feature (163)..(163): Xaa is any aa, unknown or other
  misc_feature (166)..(166): Xaa is any aa, unknown or other
  misc_feature (184)..(184): Xaa is any aa, unknown or other
  misc_feature (187)..(187): Xaa is any aa, unknown or other
MFSAQNKIHKDKGVAPTDFEQEVAQAFFDLENTNQELKSDLKDLYINQAVQMDCSGNRKAIVIYVPFRLRKAFRKIHPRLVRELEKKFSGKDVIFVATXRIMRPPKXGXXVQXXRNRTXXSVHEXMXXDVAYPAEIVGKXXRYRVDGXKIMKVYLEPKERNNXEYXLETMVGVYRKLTGKDVVXEYXVADP

SEQ ID NO: 7011 - protein, 190 aa, Brassica napus
  misc_feature (1)..(190): useful for making plants with modified plant phenotypes as described in USSN 12/139,269
  misc_feature (1)..(190): Public GI no. 4128206
  misc_feature (1)..(190): Utility: Useful for making larger plants
  misc_feature (1)..(190): Utility: Useful for making plants with increased biomass and foliage
  misc_feature (1)..(190): Utility: Useful for making smaller plants
MYTALQKIHKDKDAEPTEFEENVAQALFDFENTNQEIKSDLKDLYINSALQIDVSGGKKAVVIHVPYRLRKSFRKIHPRLVRELEKKFSGKEVVLIATRRILRPPKKGSAVQRPRSRTLTAVHDAMLEDIVYPAEIVGKRVRYRLDGSKIMKVFLDPKAKNDTENKLETFAGVYRKLSGKDVVFEFPLTE

SEQ ID NO: 7012 - protein, 192 aa, Brassica napus
  misc_feature (1)..(192): useful for making plants with modified plant phenotypes as described in USSN 12/139,269
  misc_feature (1)..(192): Public GI no. 57471724
  misc_feature (1)..(192): Utility: Useful for making larger plants
  misc_feature (1)..(192): Utility: Useful for making plants with increased biomass and foliage
  misc_feature (1)..(192): Utility: Useful for making smaller plants
MYTARKKIQKDKGVEPSEFEDTVAQAFFDLENGNQELKSDLKDLYINTAIQMDVVGNRKAVVIHVPYRLRKPFRKIHVRLVRELEKKFSGKDVVFVATRRIVRPPKKGSAVQRPRTRTLTAVHDGILEDVVYPAEIVGKRVRYRLDGAKVIKIYLDPKERNNTEYKLETFSAVYRRLCGKDVVFEYPVTETA

SEQ ID NO: 7013 - protein, 192 aa, Zea mays
  misc_feature (1)..(192): useful for making plants with modified plant phenotypes as described in USSN 12/139,269
  misc_feature (1)..(192): Ceres CLONE ID no. 1283519
  misc_feature (1)..(192): Utility: Useful for making larger plants
  misc_feature (1)..(192): Utility: Useful for making plants with increased biomass and foliage
  misc_feature (1)..(192): Utility: Useful for making smaller plants
MYTARKKIQKEKGLEPSEFEDSVAQAFFDLENGNQELKSDLKDLYINNAIQMDVTGSRKAVVIHVPYRLRKAFRKIHVRLVRELEKKFSGKDVVIVATRRIVRPPKKGSAVLRPRTRTLTAVHDGILEDVVYPAEIVGKRVRYRLDGSKIIKIFLDPKERNNTEYKLETCTAVYRRLCGKDVVFEYPMTENA

SEQ ID NO: 7014 - protein, 192 aa, Zea mays
  misc_feature (1)..(192): useful for making plants with modified plant phenotypes as described in USSN 12/139,269
  misc_feature (1)..(192): Ceres CLONE ID no. 283165
  misc_feature (1)..(192): Utility: Useful for making larger plants
  misc_feature (1)..(192): Utility: Useful for making plants with increased biomass and foliage
  misc_feature (1)..(192): Utility: Useful for making smaller plants
MYTARKKIQKDKGLEPSEFEDSVAQAFFDLENGNQELKSDLKDLYINGAIQLDVAGSRKAVVIHVPYRLRKAFRKIHVRIVRELEKKFSGKDVVIVATRRIVRPPKKGSAVQRPRTRTLTAVHDGILEDVVFPAEIVGKRVRYRLDGAKIIKIFLDPKERNNTEYKLDTYTTVYRRLCGKDVVFEYPMAENA

SEQ ID NO: 7015 - protein, 192 aa, Zea mays
  misc_feature (1)..(192): useful for making plants with modified plant phenotypes as described in USSN 12/139,269
  misc_feature (1)..(192): Public GI no. 55167942
  misc_feature (1)..(192): Utility: Useful for making larger plants
  misc_feature (1)..(192): Utility: Useful for making plants with increased biomass and foliage
  misc_feature (1)..(192): Utility: Useful for making smaller plants
MYTARRKIQKDKGLEPTEFEDTVAQAFFDLENGNQELKSDLKDLYINGAVQMDLPGNRKAVIIYVPYRLRKAYKKIHVRLVRELEKKFSGKDVVLVATRRIVRPPKKGSAVVRPRTRTLTAVHDGILEDVVYPAEIVGKRVRYHLDGRKIMKIFLDPKERNNTEYKLDTFSSVYRRLCGKDVVFDYPMTETA

SEQ ID NO: 7016 - protein, 192 aa, Zea mays
  misc_feature (1)..(192): useful for making plants with modified plant phenotypes as described in USSN 12/139,269
  misc_feature (1)..(192): Ceres CLONE ID no. 259723
  misc_feature (1)..(192): Utility: Useful for making larger plants
  misc_feature (1)..(192): Utility: Useful for making plants with increased biomass and foliage
  misc_feature (1)..(192): Utility: Useful for making smaller plants
MYTARKKIQKDKGLEPSEFEDSVAQAFFDLENGNQELKSDLKDLYIIGAIQLDVAGSRKAVVIHVPYRLRKAFRKIHVRIVRELEKKFSGKDVVIVATRRIVRPPKKGSAVQRPRTRTLTAVHDGILEDVVFPAEIVGKRVRYRLDGAKIIKIFLDPKERNNTEYKLDTYTTVYRRLCGKDVVFEYPMAENA

SEQ ID NO: 7017 - protein, 192 aa, Zea mays
  misc_feature (1)..(192): useful for making plants with modified plant phenotypes as described in USSN 12/139,269
  misc_feature (1)..(192): Public GI no. 22671664
  misc_feature (1)..(192): Utility: Useful for making larger plants
  misc_feature (1)..(192): Utility: Useful for making plants with increased biomass and foliage
  misc_feature (1)..(192): Utility: Useful for making smaller plants
MYTARRKIQKDKGLEPTEFEDTVAQAFFDLENGNQELKSDLKDLYINGAVQMDLPGNRKAVIIHVPYRLRKAYKKIHVRLVRELEKKFSGKDVVLVATRRIVRPPKKGSAVVRPRTRTLTAVHDGILEDVVYPAEIVGKRVRYHLDGRKIMKIFLDPKERNNTEYKLDTFSSVYRRLCGKDVVFDYPMTETA

SEQ ID NO: 7018 - DNA, 1481 bp, Arabidopsis thaliana
  misc_feature (1)..(1481): useful for making plants with modified plant phenotypes as described in USSN 12/139,269
  misc_feature (1)..(1481): Ceres CLONE ID no. 156655
  misc_feature (1)..(1481): Also known as  Ceres CDNA ID no. 23371009
gcgttacactacaactctctatctctctctcttcttttctgctcatttttgggtaattcttctggttttatgttcttgttcctattactgactcacaatcagccaacgcaaatctttctttgaccatttttaatagattctcttagtcacttgttggatttcaaatgcaaagttgacctcatcttcttcttcttcgaggttttatacaagttactccataaaccttcgagcttccagcaactttggcttctctgttgtgaattattgcttattatatcctcaacacgaaatcaaaatgccaagaccaagagtttcagagttgtctcagaggcaagctccaaggctgaggtcatcgtcatctacttctgattccaatcattccaaccgtctgatcactacggatcaaagttttaagcccggtgttgaccgtaaatctcctcgaagcggtggacctaacagtgatccgcttggtcagaagaaacttgggggacgaatatcggatctagagtcgcagttaggacaagcgcaagaggaactgagattgctcaaggagcagttggctaatgctgaagctgtgaagaaacaagctcaagatgagcttcataagaagtccaagaaaccaaacccgctggctcgagtggaggaatctgcaactgaggctgagaggattgatagagacgaaatccctggtgatgtgcagaaagagactgatgtgtttgaggttcccgttgaaaagattgcagtagaagaagaagaactgagaagcggcaatgacgaagctgagaaattggttgcaaaggaagatgagataaagatgctgaaagctagactctatgacatggagaaagagcatgaatcactaggcaaagaaaacgagagcttgaagaatcagttgagcgattcagcttcagagatttctaatgtgaaagctaatgaagatgagatggtttcaaaggtgagtaggattggggaagagttagaagaaagcagagcaaagacggctcacctgaaggagaagcttgagtccatggaagaagcaaaagatgctttagaggctgagatgaagaagctcagggttcaaaccgagcagtggaggaaggcagcggatgctgcagcagcagttctttctggagagtttgagatgaatggtcgggatcgatctgggtcaactgagaagtattatgcaggtgggttctttgacccgtcagctgggttcatggatccaccgggaatggctgatgattatgatgatggactgggaagtggcaagaggaagagttctgggatgaagatgtttggtgagttgtggaggaagaaagggcaaaagtgagttacagattgtgtggagtgtcattcaagaaatggtgtgctcaccgtttctctcttttattttgctgtatttacctggaagtttttgtaagtgggtccgcttcatcagaagctaactatcaatccaaatcaattgcaaaaacaatttcatg

SEQ ID NO: 7019 - protein, 344 aa, Arabidopsis thaliana
  misc_feature (1)..(344): useful for making plants with modified plant phenotypes as described in USSN 12/139,269
  misc_feature (14)..(102): Pfam Name: DUF827; Pfam Description: Plant protein of unknown function (DUF827)
  misc_feature (14)..(102): Pfam Name: DUF827; Pfam Description: Plant protein of unknown function (DUF827)
  misc_feature (1)..(344): Utility: Useful for making larger plants
  misc_feature (1)..(344): Utility: Useful for making ornamental plants with modified flowers
  misc_feature (1)..(344): Utility: Useful for making ornamental plants with modified leaves
  misc_feature (1)..(344): Utility: Useful for making plants sterile and for genetic confinement
  misc_feature (1)..(344): Utility: Useful for making stronger plants
  misc_feature (1)..(344): Utility: Useful for making taller plants and plants with longer inflorescences
MPRPRVSELSQRQAPRLRSSSSTSDSNHSNRLITTDQSFKPGVDRKSPRSGGPNSDPLGQKKLGGRISDLESQLGQAQEELRLLKEQLANAEAVKKQAQDELHKKSKKPNPLARVEESATEAERIDRDEIPGDVQKETDVFEVPVEKIAVEEEELRSGNDEAEKLVAKEDEIKMLKARLYDMEKEHESLGKENESLKNQLSDSASEISNVKANEDEMVSKVSRIGEELEESRAKTAHLKEKLESMEEAKDALEAEMKKLRVQTEQWRKAADAAAAVLSGEFEMNGRDRSGSTEKYYAGGFFDPSAGFMDPPGMADDYDDGLGSGKRKSSGMKMFGELWRKKGQK

SEQ ID NO: 7020 - protein, 326 aa, Arabidopsis thaliana
  misc_feature (1)..(326): useful for making plants with modified plant phenotypes as described in USSN 12/139,269
  misc_feature (1)..(326): Ceres CLONE ID no. 1342938
  misc_feature (1)..(326): Utility: Useful for making larger plants
  misc_feature (1)..(326): Utility: Useful for making ornamental plants with modified flowers
  misc_feature (1)..(326): Utility: Useful for making ornamental plants with modified leaves
  misc_feature (1)..(326): Utility: Useful for making plants sterile and for genetic confinement
  misc_feature (1)..(326): Utility: Useful for making stronger plants
  misc_feature (1)..(326): Utility: Useful for making taller plants and plants with longer inflorescences
MPKPRLGIRGSELPQRQSPRLRTSLLSTSSDPHHLSRPITDRSPKLGLDRRSPRSGGPHTDPLSQKKLGSRISGLESQLGQAQEELRLLKQQLAKAEAAKKRAQEELHRKKSKKPNTPAPERDDIPGDGHQETDVFEVLDEKAKESEKTKNDELASKEDQINVLKARLYDLEKERVSLSEENETLKDQLKKTDTEMSCAKAKEDEIASKVSQIGEELEESNETTAKLKKKLESVEEAKETLEAEMKKLKVQTEQWRKAADAAAAVLSGGVEMNGRFSEQCGSMEKHFAGRFVGSPGMADDSDDGSGKRKSSGKKMFGDLWKKKGQK

SEQ ID NO: 7021 - protein, 377 aa, Zea mays
  misc_feature (1)..(377): useful for making plants with modified plant phenotypes as described in USSN 12/139,269
  misc_feature (1)..(377): Ceres CLONE ID no. 302736
  misc_feature (1)..(377): Utility: Useful for making larger plants
  misc_feature (1)..(377): Utility: Useful for making ornamental plants with modified flowers
  misc_feature (1)..(377): Utility: Useful for making ornamental plants with modified leaves
  misc_feature (1)..(377): Utility: Useful for making plants sterile and for genetic confinement
  misc_feature (1)..(377): Utility: Useful for making stronger plants
  misc_feature (1)..(377): Utility: Useful for making taller plants and plants with longer inflorescences
  misc_feature (89)..(89): Xaa is any aa, unknown or other
  misc_feature (295)..(295): Xaa is any aa, unknown or other
  misc_feature (296)..(296): Xaa is any aa, unknown or other
  misc_feature (297)..(297): Xaa is any aa, unknown or other
  misc_feature (299)..(299): Xaa is any aa, unknown or other
MPRSRGNEPPLRTSQRAPLHLKTTACSEANGAHHRPVADRSSPRVSPRSPLPEKKHAAGTRVAELEGKLGKVQEELKKLREQLASAEAXKKDAQVALEEAKKRVGTKGSPASTTTTTPLSPPSPGVEIAKKTEELKLPQPAAEEESSINVPATDVFEVVRAESGDKENQSAAEVCEVVSCGGGKAAVDVAENEETEEEETKKMIGEDNSAAVESDGADKESPEVVELKAKLAEKDTEIAALTAENAELKKQAEEAAEAAKKAEEGPASRAAKAEHELKEGAAREARVGEQLRASXXXRXALDGELRRLRVQTEQWRKAAEAAAAVLGGDNHLTGLAGNGWGSPATMPDDGDDEGFGGKRKGAGIRVLGDLWKRKGSK

SEQ ID NO: 7022 - protein, 410 aa, Zea mays
  misc_feature (1)..(410): useful for making plants with modified plant phenotypes as described in USSN 12/139,269
  misc_feature (1)..(410): Public GI no. 51451351
  misc_feature (1)..(410): Utility: Useful for making larger plants
  misc_feature (1)..(410): Utility: Useful for making ornamental plants with modified flowers
  misc_feature (1)..(410): Utility: Useful for making ornamental plants with modified leaves
  misc_feature (1)..(410): Utility: Useful for making plants sterile and for genetic confinement
  misc_feature (1)..(410): Utility: Useful for making stronger plants
  misc_feature (1)..(410): Utility: Useful for making taller plants and plants with longer inflorescences
MHVKFFGELNDRAVFEMPHRTSPRAPVRSKTTAAAPAAAGSEHHRDRVVVGAGGGAARGTVCMVACLQKKPAGGGAAVSRVAELEAKLGKAEGQLAEMREQLAAAEKARKDARAALVESKKRFSAAKKRVATAGAASSSAAAEQTPPQAVSDEKCGVISPAGDVPEAAEPGDAQGEETKEMADDDEVNSVTAAIVGDLEGNKGGQEVEQLRTKLMEKDMEVYELKAKLIAMDAEADDLRASLATKGMEIDELRAKLTSKDADIAAVEADNAELMKMAEEASHAVKETATKARDTEHALRESAAREAARVAERLRASERAREALEAELQRGRAQSEQWRKAAEEAAAVLAAVEHGAGAPAADVEWRRHSSGAAAGERVAKDTDEHHVSGGKRNSGGAMRMLSELWKKKAQK

SEQ ID NO: 7023 - DNA, 621 bp, Arabidopsis thaliana; identical to SEQ ID NO: 4718
  misc_feature (1)..(621): useful for making plants with modified plant phenotypes as described in USSN 12/139,269
  misc_feature (1)..(621): Ceres CLONE ID no. 2273
  misc_feature (1)..(621): Also known as  Ceres CDNA ID no. 23356705

SEQ ID NO: 7024 - protein, 115 aa, Arabidopsis thaliana; identical to SEQ ID NO: 4719
  misc_feature (1)..(115): useful for making plants with modified plant phenotypes as described in USSN 12/139,269
  misc_feature (1)..(115): Utility: Useful for making lethal plants for genetic confinement systems
  misc_feature (1)..(115): Utility: Useful for making plants with increased biomass and foliage
  misc_feature (1)..(115): Utility: Useful for making smaller plants

SEQ ID NO: 7025 - protein, 129 aa, Brassica napus; identical to SEQ ID NO: 4734
  misc_feature (1)..(129): useful for making plants with modified plant phenotypes as described in USSN 12/139,269
  misc_feature (1)..(129): Ceres CLONE ID no. 963126
  misc_feature (1)..(129): Utility: Useful for making lethal plants for genetic confinement systems
  misc_feature (1)..(129): Utility: Useful for making plants with increased biomass and foliage
  misc_feature (1)..(129): Utility: Useful for making smaller plants

SEQ ID NO: 7026 - protein, 129 aa, Brassica napus
  misc_feature (1)..(129): useful for making plants with modified plant phenotypes as described in USSN 12/139,269
  misc_feature (1)..(129): Ceres CLONE ID no. 1118497
  misc_feature (1)..(129): Utility: Useful for making lethal plants for genetic confinement systems
  misc_feature (1)..(129): Utility: Useful for making plants with increased biomass and foliage
  misc_feature (1)..(129): Utility: Useful for making smaller plants
MDDLELLQDLSQFNFPATIKIPSKTSKDNKDGDGDNDEVFSCSTPTSQEHKIPSVHDSPPPPPRKPRALPSKPSPTAALMIRSCKRKLLVSTPEIIMNKEEIDRFFSSVYSDTSTTAKRRRRYLYCARR

SEQ ID NO: 7027 - DNA, 528 bp, Arabidopsis thaliana
  misc_feature (1)..(528): useful for making plants with modified plant phenotypes as described in USSN 12/139,269
  misc_feature (1)..(528): Ceres CLONE ID no. 4043
  misc_feature (1)..(528): Also known as  Ceres CDNA ID no. 23364928
aaataacaaaaaaatggagattaacaaatttctggccgtagtcgtagtcgtcgtggtcctctactccgtcgaagcgacggcacaaggaggaagccctcagttgacggcttgtctgcacaaactgctgccgtgtcagccgtacatacactcattgaatccgcctcctccgccatcgtgttgcgggccaatgaaagagatcgtagagaaagacgcaccgtgtttatgcaccgcttttaacaatccggaggtgctcaaagccctaaacctcaccaaagagaacgctctcctacttcccaatgcatgtggagttaatcctgacgtttcactctgctccaaaatagccactccttcgcctattgcgtcgccgggatcaaccaatggaacttcttcagcttcaactatcagcttcaatcgatttagctttctgtctgcttttgtggcaatgatcttcttctgattatgtcattttttaatttataattatatgtgtgatgactgtgtaattcggtcatcagaatgtgtttaagt

SEQ ID NO: 7028 - protein, 147 aa, Arabidopsis thaliana
  misc_feature (1)..(147): useful for making plants with modified plant phenotypes as described in USSN 12/139,269
  misc_feature (33)..(106): Pfam Name: Tryp_alpha_amyl; Pfam Description: Protease inhibitor/seed storage/LTP family
  misc_feature (33)..(106): Pfam Name: Tryp_alpha_amyl; Pfam Description: Protease inhibitor/seed storage/LTP family
  misc_feature (1)..(147): Utility: Useful for making lethal plants for genetic confinement systems
  misc_feature (1)..(147): Utility: Useful for making ornamental plants with modified leaves
  misc_feature (1)..(147): Utility: Useful for making plants with altered leaf shape eg curled leaves
  misc_feature (1)..(147): Utility: Useful for making plants with increased biomass and foliage
  misc_feature (1)..(147): Utility: Useful for making smaller plants
MEINKFLAVVVVVVVLYSVEATAQGGSPQLTACLHKLLPCQPYIHSLNPPPPPSCCGPMKEIVEKDAPCLCTAFNNPEVLKALNLTKENALLLPNACGVNPDVSLCSKIATPSPIASPGSTNGTSSASTISFNRFSFLSAFVAMIFF

SEQ ID NO: 7029 - DNA, 527 bp, Arabidopsis thaliana
  misc_feature (1)..(527): useful for making plants with modified plant phenotypes as described in USSN 12/139,269
  misc_feature (1)..(527): Ceres CLONE ID no. 5198
  misc_feature (1)..(527): Also known as  Ceres CDNA ID no. 23388071
atatacaaaaacaaaacgtttagttgttggaaatggcagcgaaactccgcatttcctcttcttcgtttagccacagaactaatgattccaaaacctcatcatcttcttcatattcatcattgcttgctttgcctcaattcctctgtccaccatctccattaggattcccacagttcaagcttcacgccaaattaggtggacgagatggagaagtgaagcctaaagataagaagaagttcattaccaaagaggaagaaccagaacagtattggcaaagcgttggagaaagagaaggagagaatccgatgaagacgcctcttccttacattatcatcttcggtatgtcaacgccattcgtcatcttagccattgcttttgccaatggttggatcaaagttcccattcgttgatagcctttcttttttgcttctgctacacttgtgtaaggctgaatcttaaacatgttttcttatactcttcttcttcggctgtaaaaatagcaaaattaatagaatggatcatatgtt

SEQ ID NO: 7030 - protein, 125 aa, Arabidopsis thaliana
  misc_feature (1)..(125): useful for making plants with modified plant phenotypes as described in USSN 12/139,269
  misc_feature (1)..(125): Utility: Useful for making lethal plants for genetic confinement systems
  misc_feature (1)..(125): Utility: Useful for making ornamental plants with modified leaves
  misc_feature (1)..(125): Utility: Useful for making plants with increased biomass and foliage
  misc_feature (1)..(125): Utility: Useful for making smaller plants
MAAKLRISSSSFSHRTNDSKTSSSSSYSSLLALPQFLCPPSPLGFPQFKLHAKLGGRDGEVKPKDKKKFITKEEEPEQYWQSVGEREGENPMKTPLPYIIIFGMSTPFVILAIAFANGWIKVPIR

SEQ ID NO: 7031 - protein, 124 aa, Brassica napus
  misc_feature (1)..(124): useful for making plants with modified plant phenotypes as described in USSN 12/139,269
  misc_feature (1)..(124): Ceres CLONE ID no. 954882
  misc_feature (1)..(124): Utility: Useful for making lethal plants for genetic confinement systems
  misc_feature (1)..(124): Utility: Useful for making ornamental plants with modified leaves
  misc_feature (1)..(124): Utility: Useful for making plants with increased biomass and foliage
  misc_feature (1)..(124): Utility: Useful for making smaller plants
  misc_feature (27)..(27): Xaa is any aa, unknown or other
  misc_feature (28)..(28): Xaa is any aa, unknown or other
MAAKLHISSSFSHKANDSPTSSSSSYXXFLALPQFLCTPFSSGFAQFKLHAKLGGGDGEVKPKEKKKFITKEEEPEQYWQSAGEREGENPMKTPLPYIIIFGMSTPFVILAIAFANGWIKVPIR

SEQ ID NO: 7032 - protein, 118 aa, Brassica napus
  misc_feature (1)..(118): useful for making plants with modified plant phenotypes as described in USSN 12/139,269
  misc_feature (1)..(118): Public GI no. 34896996
  misc_feature (1)..(118): Utility: Useful for making lethal plants for genetic confinement systems
  misc_feature (1)..(118): Utility: Useful for making ornamental plants with modified leaves
  misc_feature (1)..(118): Utility: Useful for making plants with increased biomass and foliage
  misc_feature (1)..(118): Utility: Useful for making smaller plants
MAKVALSSLLAVGGAAAFAVQPSKKTGSGLFRNRVITVRRPRISANLGGDGEVKPAGNKKKFITREEEPEQYWQAAGERKGENPMKTPLPYIIIFGMSTPFVILAIAFANGWIKVPVR

SEQ ID NO: 7033 - protein, 119 aa, Zea mays
  misc_feature (1)..(119): useful for making plants with modified plant phenotypes as described in USSN 12/139,269
  misc_feature (1)..(119): Ceres CLONE ID no. 370168
  misc_feature (1)..(119): Utility: Useful for making lethal plants for genetic confinement systems
  misc_feature (1)..(119): Utility: Useful for making ornamental plants with modified leaves
  misc_feature (1)..(119): Utility: Useful for making plants with increased biomass and foliage
  misc_feature (1)..(119): Utility: Useful for making smaller plants
MAKAAPPLLAAGSRTAITAQQPSSRKGAAGTGLFCSRAIVSKRTRVTAKLGDGELKPAGKRKFITKEEEPEQYWQTAGEREGENPMMTPLPYIIIFGMSTPFVILAIAFANGWIKVPVR

SEQ ID NO: 7034 - protein, 119 aa, Zea mays
  misc_feature (1)..(119): useful for making plants with modified plant phenotypes as described in USSN 12/139,269
  misc_feature (1)..(119): Ceres CLONE ID no. 1577130
  misc_feature (1)..(119): Utility: Useful for making lethal plants for genetic confinement systems
  misc_feature (1)..(119): Utility: Useful for making ornamental plants with modified leaves
  misc_feature (1)..(119): Utility: Useful for making plants with increased biomass and foliage
  misc_feature (1)..(119): Utility: Useful for making smaller plants
MAKAAPPLLAAGSRTAITAQQPSSRKGAAGAGLFCSRVIVSKRARVTAKLGDGELKPAGKRKFITKEEEPEQYWQTAGEREGENPMMTPLPYIIIFGMSTPFVILAIAFANGWIKVPVR

SEQ ID NO: 7035 - protein, 115 aa, Glycine max
  misc_feature (1)..(115): useful for making plants with modified plant phenotypes as described in USSN 12/139,269
  misc_feature (1)..(115): Ceres CLONE ID no. 562212
  misc_feature (1)..(115): Utility: Useful for making lethal plants for genetic confinement systems
  misc_feature (1)..(115): Utility: Useful for making ornamental plants with modified leaves
  misc_feature (1)..(115): Utility: Useful for making plants with increased biomass and foliage
  misc_feature (1)..(115): Utility: Useful for making smaller plants
MAAKLTLSSPFSFKTSFLPKSPSFSLGLYSPRTNVTGVKVHAKLGGGDEQAKKGGKKKFITREEEPQQYWQTAGEREGENPMKTPLPYIIIFGMSTPFVILAIAFANGWIKVPVR

SEQ ID NO: 7036 - protein, 115 aa, Glycine max
  misc_feature (1)..(115): useful for making plants with modified plant phenotypes as described in USSN 12/139,269
  misc_feature (1)..(115): Ceres CLONE ID no. 1046446
  misc_feature (1)..(115): Utility: Useful for making lethal plants for genetic confinement systems
  misc_feature (1)..(115): Utility: Useful for making ornamental plants with modified leaves
  misc_feature (1)..(115): Utility: Useful for making plants with increased biomass and foliage
  misc_feature (1)..(115): Utility: Useful for making smaller plants
  misc_feature (99)..(99): Xaa is any aa, unknown or other
MAAKLTLSSPLSFKTSFLPKSPSFSPGLCSPRTNVTGVKVHAKLGGGDEQAKNGGKKKFITREEEPQQYWQTAGEREGENPMKTPLPYIIIFGMSTPFXILAIAFANGWIKVPVR

SEQ ID NO: 7037 - protein, 134 aa, Zea mays
  misc_feature (1)..(134): useful for making plants with modified plant phenotypes as described in USSN 12/139,269
  misc_feature (1)..(134): Ceres CLONE ID no. 1520658
  misc_feature (1)..(134): Utility: Useful for making lethal plants for genetic confinement systems
  misc_feature (1)..(134): Utility: Useful for making ornamental plants with modified leaves
  misc_feature (1)..(134): Utility: Useful for making plants with increased biomass and foliage
  misc_feature (1)..(134): Utility: Useful for making smaller plants
  misc_feature (72)..(72): Xaa is any aa, unknown or other
  misc_feature (73)..(73): Xaa is any aa, unknown or other
  misc_feature (74)..(74): Xaa is any aa, unknown or other
  misc_feature (75)..(75): Xaa is any aa, unknown or other
  misc_feature (76)..(76): Xaa is any aa, unknown or other
  misc_feature (77)..(77): Xaa is any aa, unknown or other
  misc_feature (81)..(81): Xaa is any aa, unknown or other
  misc_feature (82)..(82): Xaa is any aa, unknown or other
  misc_feature (83)..(83): Xaa is any aa, unknown or other
  misc_feature (99)..(99): Xaa is any aa, unknown or other
MAKAAPPLLAAGSRTAITAQQPSSRKGAAGTGLFCSRAIVSKRTRVTAKLGDGELKPAGKRKFITKEEEPDXXXXXXRGEXXXGKNPMMTPLPYIIIFXHVHPLRHPRHRLRQWLDQGPCAMTVTRSASLNHRC

SEQ ID NO: 7038 - DNA, 1201 bp, Arabidopsis thaliana
  misc_feature (1)..(1201): useful for making plants with modified plant phenotypes as described in USSN 12/139,269
  misc_feature (1)..(1201): Ceres CLONE ID no. 13767
  misc_feature (1)..(1201): Also known as  Ceres CDNA ID no. 23356776
actgaatatttcagtaaataatctcttcttagatctctccggcaatggcaattccgttgcctcttacctcttgctccccaatctcaacttcttcgtctatttcccgaacctccttcgtccctcttacacttcgcaatcgtactttcttctccaaccagaattacagtaggcgtgtacttatcagctgctcttcttctttgtcctcagacaatggttcatctccagactccatgaacggaaacgggaacgggaacgggagtagcttaaacgggcaatcatctttcccacgactgccttcctttgatggaacatccaaaccaccgcttaaatggagaagggttttactcaaagtcagtggagaagctcttgctggagacgaggagcaaaatatcgacccaaaggttactatggcgattgcaagggaagttgcagcagtgactcgacttggcattgaggttgctatagttgttggaggaggaaatatctttcgtggatctacctgggctgggtgcagtggccttgatcgctcctctgctgattatatcgggatgctggcaactgtgatgaatgcaatatttcttcaagcgacaatggagagtattggcatcccaacccgtgttcaaactgctttccgcatgtcggaagtcgcagagccttacataagaagacgagcaatcagacatctagaaaaaggaagggttgtaatatttgcagctggaacaggcaatccatttttcaccaccgatactgcagcggctcttcgatgtgctgaaattaatgcagaagtagtgctgaaagcaacaaatgttgatggcgtgttcgacgatgatcctaaaagaaacccaaacgctcgtctgcttgactcactaacttaccaagagatcacctcaaaggacctctctgtaatggatatgactgctatcactttgtgccaagaaaataacatcccagttgttgtattcaatctttcggaacctgggaacatcgccaaagcaatcaaaggagagagagttggtacattgataggaggaacttggaactccattgttacaacaacctcatgaagaagcctattctcaaaacacaaaacttattagagtatcttaggtcaggagaatcttgtaactcctgtatatattagtttgcagacaagttttacattctaggaatctgtctgaaatttttgaaagttaatcttttt

SEQ ID NO: 7039 - protein, 339 aa, Arabidopsis thaliana
  misc_feature (1)..(339): useful for making plants with modified plant phenotypes as described in USSN 12/139,269
  misc_feature (97)..(307): Pfam Name: AA_kinase; Pfam Description: Amino acid kinase family
  misc_feature (97)..(307): Pfam Name: AA_kinase; Pfam Description: Amino acid kinase family
  misc_feature (1)..(339): Utility: Useful for making lethal plants for genetic confinement systems
  misc_feature (1)..(339): Utility: Useful for making plants sterile and for genetic confinement
  misc_feature (1)..(339): Utility: Useful for making smaller plants
MAIPLPLTSCSPISTSSSISRTSFVPLTLRNRTFFSNQNYSRRVLISCSSSLSSDNGSSPDSMNGNGNGNGSSLNGQSSFPRLPSFDGTSKPPLKWRRVLLKVSGEALAGDEEQNIDPKVTMAIAREVAAVTRLGIEVAIVVGGGNIFRGSTWAGCSGLDRSSADYIGMLATVMNAIFLQATMESIGIPTRVQTAFRMSEVAEPYIRRRAIRHLEKGRVVIFAAGTGNPFFTTDTAAALRCAEINAEVVLKATNVDGVFDDDPKRNPNARLLDSLTYQEITSKDLSVMDMTAITLCQENNIPVVVFNLSEPGNIAKAIKGERVGTLIGGTWNSIVTTTS

SEQ ID NO: 7040 - protein, 351 aa, Arabidopsis thaliana
  misc_feature (1)..(351): useful for making plants with modified plant phenotypes as described in USSN 12/139,269
  misc_feature (1)..(351): Public GI no. 57900163
  misc_feature (1)..(351): Utility: Useful for making lethal plants for genetic confinement systems
  misc_feature (1)..(351): Utility: Useful for making plants sterile and for genetic confinement
  misc_feature (1)..(351): Utility: Useful for making smaller plants
MAAAAAAAVACGMSTSFLIRLSPSPPASSHVPLPRSPASSARPRRASSVSLSTAPRPRARAAGSDSPSNFGGQTSLMPPFSLMLDEGSRSKKPYRWQRVLLKVSGEALAGDHTENIDPKITMAIAREVASVTRLGVEVAIVVGGGNIFRGASWAGCSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDADPKRNPNARLLEAVSYHEVQTRDLSVMDMTAITLCQENNIPVVVFNLQKPGNIAKAIVGEKVGTFIGCTKDQDQIVGNALDQERRLVNEL

SEQ ID NO: 7041 - protein, 342 aa, Zea mays
  misc_feature (1)..(342): useful for making plants with modified plant phenotypes as described in USSN 12/139,269
  misc_feature (1)..(342): Ceres CLONE ID no. 289382
  misc_feature (1)..(342): Utility: Useful for making lethal plants for genetic confinement systems
  misc_feature (1)..(342): Utility: Useful for making plants sterile and for genetic confinement
  misc_feature (1)..(342): Utility: Useful for making smaller plants
MAASAAAAGPATFLPRLPSPRSPSPMLPPLGRRAHPVAAPLCLSAKRRACAAMGSSSSSNSGNQTSLMLPFSFTFDEDSSSSRRLYRWKRVLLKVSGEALAGNHTENIDPKITMAIAREVASVTKLGVEVAIVVGGGNIFRGASWAGCSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDADPRQNPNARLLETVSYHEVTTRDLSVMDMTAITLCQENNIPIVVFNLQEPGNIAKAIVGEKVGTFIGCTRDQELNGNTLVQERRLVNEA

SEQ ID NO: 7042 - protein, 331 aa, Glycine max
  misc_feature (1)..(331): useful for making plants with modified plant phenotypes as described in USSN 12/139,269
  misc_feature (1)..(331): Ceres CLONE ID no. 1168763
  misc_feature (1)..(331): Utility: Useful for making lethal plants for genetic confinement systems
  misc_feature (1)..(331): Utility: Useful for making plants sterile and for genetic confinement
  misc_feature (1)..(331): Utility: Useful for making smaller plants
MALYTHLISFSSSSFLHSPSPLCLPKPLFPSFTLTVGNSTSHTTSLAVRSSYSEMGSSPEPINFRKPGIPSMSHLRLSMNESSKPSFKWRRVLLKVSGEALAGDHSQNIDPKITMAIAREVAAVTRLGIEVALVVGGGNIFRGSSWAGSSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVFDEDPKRNPQARLHETLTYQEVTSKDLSVMDMTAITLCQENNIPVVVFNLNKPGNIEKAIKGERVGTLIGATWNSTVSRT

SEQ ID NO: 7043 - protein, 342 aa, Zea mays
  misc_feature (1)..(342): useful for making plants with modified plant phenotypes as described in USSN 12/139,269
  misc_feature (1)..(342): Ceres CLONE ID no. 243668
  misc_feature (1)..(342): Utility: Useful for making lethal plants for genetic confinement systems
  misc_feature (1)..(342): Utility: Useful for making plants sterile and for genetic confinement
  misc_feature (1)..(342): Utility: Useful for making smaller plants
MAASAAAAGPATFLPRLPSPRSPSPMLPPLGRRAHPVAAPLCLSAKRRACAAMGSSSSSNSGNQTSLMLPFSFTFDEDSSSSRRLYRWKRVLLKVSGEALAGNHTENIDPKITMAIAREVASVTKLGVEVAIVVGGGNIFRGASWAGCSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDADPRQNPNARLLETVSYHEVTTRDLSVMDMTAITLFQENNIPIVVFNLQEPGNIAKAIVGEKVGTFIGCTRDQELNGNTLVQERRLVNEA

SEQ ID NO: 7044 - protein, 352 aa, Triticum aestivum
  misc_feature (1)..(352): useful for making plants with modified plant phenotypes as described in USSN 12/139,269
  misc_feature (1)..(352): Ceres CLONE ID no. 579504
  misc_feature (1)..(352): Utility: Useful for making lethal plants for genetic confinement systems
  misc_feature (1)..(352): Utility: Useful for making plants sterile and for genetic confinement
  misc_feature (1)..(352): Utility: Useful for making smaller plants
MAAAAGVSPSSLLRLRLPSPHPAASLPSPSPALLRRRPLLSVAAAPQRASVAAAADSSNGNGSYSGNGSQALLMPPFSGLMLDESSRSKRPYKWQRVLLKVSGEALAGDHTENIDPKVTMAIAREVASVTKLGVEVAIVVGGGNIFRGASWAGCSGLDRSSADYIGMMATVMNAIFLQATMESIGIPTRVQTAFRISEVAEPYIRRRAIRHLEKGRVVIFAAGTGNPFFTTDTAAALRCAEINAEVVLKATNVDGVYDANPKHNPNARILETVSYNEVISRDLSVMDMTAVTLCQENNIPVVVFNLQNTGNIAKAIVGEKVGTFIGCTRNLEYRESTEGSLDQEDKILVSEW

SEQ ID NO: 7045 - protein, 312 aa, Glycine max
  misc_feature (1)..(312): useful for making plants with modified plant phenotypes as described in USSN 12/139,269
  misc_feature (1)..(312): Ceres CLONE ID no. 467253
  misc_feature (1)..(312): Utility: Useful for making lethal plants for genetic confinement systems
  misc_feature (1)..(312): Utility: Useful for making plants sterile and for genetic confinement
  misc_feature (1)..(312): Utility: Useful for making smaller plants
MSSGCISTSHWPWFKQLEQIVGNSLPAKFSDEDKAVISAGTSPRQSKRYGVATPSTGGPANSMKSKALSNSRWRRVVLKISGAALTGSDTCNIDPKVAMLVSREVAIASRLGVEVAIVVGGRNFFSGEAWVNVTGLERCTAYQVGMMATVMNSILLQSTLEKMGVQTRVQTSVAMQEFAEPYNRQRAIRHLEKGRVVIFGGIGFGAGTPLFSTDIAAALRASELNAEAVLKGTNVDGVYDCNSRDNNFTFEHISFRELGSRGVTSMDMSALTFCEENAIPVVVFNLLEPGNISKALCGEQVGTLIDQTGAIS

SEQ ID NO: 7046 - DNA, 913 bp, Arabidopsis thaliana
  misc_feature (1)..(913): useful for making plants with modified plant phenotypes as described in USSN 12/139,269
  misc_feature (1)..(913): Ceres CLONE ID no. 29150
  misc_feature (1)..(913): Also known as  Ceres CDNA ID no. 23480869
aaacaagtaaaccacaacaatggcgttgttctccccgccaatctcttcttcatctcttcaaaatcccaatttcatcccgaaattctcattctctctcctctccagtaaccgcttctctctcctctccgtcactcgagcttcctccgacagtggatcaacctctcccaccgccgccgtctccgtagaggctcctgagcccgtggaagtgatagttaaagagcctccccaatcaacaccagctgttaaaaaggaagaaaccgccaccgctaaaaatgttgccgtcgaaggtgaagagatgaaaacaacggagagtgttatcaaattccaagatgcgaggtggattaatggaacttgggatctgaaacaattcgagaaagatggaaaaaccgattgggattctgtaatcgttgctgaggcaaagagaagaaaatggctagaagagaatccagaaacaacgagtaacgacgagccagtgcttttcgatacatcgattattccatggtgggcttggattaagagataccacttacctgaagctgaactcttaaatggtcgtgcggcgatgataggattctttatggcttactttgtcgatagtcttactggagtaggacttgttgatcaaatggggaatttcttctgcaagacactattgtttgtggctgtggccggagttttgtttattcgtaagaatgaggatgtggataaactcaagaatttgtttgatgagactacattgtatgataagcaatggcaagcagcttggaaaaatgatgatgatgagtcattgggttctaagaagaagtgataacaaagattcttgctttctttttttgttgttgttgtaattaggagatgaacttaccaaatgtaatatcaagagatttgaacaatgtttcctcagattatcgtt

SEQ ID NO: 7047 - protein, 262 aa, Arabidopsis thaliana
  misc_feature (1)..(262): useful for making plants with modified plant phenotypes as described in USSN 12/139,269
  misc_feature (1)..(262): Utility: Useful for making lethal plants for genetic confinement systems
MALFSPPISSSSLQNPNFIPKFSFSLLSSNRFSLLSVTRASSDSGSTSPTAAVSVEAPEPVEVIVKEPPQSTPAVKKEETATAKNVAVEGEEMKTTESVIKFQDARWINGTWDLKQFEKDGKTDWDSVIVAEAKRRKWLEENPETTSNDEPVLFDTSIIPWWAWIKRYHLPEAELLNGRAAMIGFFMAYFVDSLTGVGLVDQMGNFFCKTLLFVAVAGVLFIRKNEDVDKLKNLFDETTLYDKQWQAAWKNDDDESLGSKKK

SEQ ID NO: 7048 - protein, 276 aa, Arabidopsis thaliana
  misc_feature (1)..(276): useful for making plants with modified plant phenotypes as described in USSN 12/139,269
  misc_feature (1)..(276): Ceres CLONE ID no. 36801
  misc_feature (1)..(276): Utility: Useful for making lethal plants for genetic confinement systems
MSISMALFSPPISSSLQNPNLIPKISTSLLSTKRFSLISVPRASSDNGTTSPVVKIPKPASVAVEEVPVKSPAESSSASENGAVGGEATDSSTETVIKYQNAKWVNGTWDLKQFEKDGKTDWDSVIVSEAKRRKWLEDNPETTSNDELVVFDTSIIPWWAWMKRYHLPEAELLNGRAAMIGFFMAYFVDSLTGVGLVDQMGNFFCKTLLFVAVAGVLFIRKNEDLDKLKDLFDETTLYDKQWQAAWKEPDSSDSFFKEVNKFLQSFIFLFLLCNNL

SEQ ID NO: 7049 - protein, 262 aa, Glycine max
  misc_feature (1)..(262): useful for making plants with modified plant phenotypes as described in USSN 12/139,269
  misc_feature (1)..(262): Ceres CLONE ID no. 470787
  misc_feature (1)..(262): Utility: Useful for making lethal plants for genetic confinement systems
MQSMSTTMASFSPPTHFSATPSSSKPRLVYKNNFFFSLRSRSLSLSPLKAAASENGVGTAVEPPPEQAVPVPEPSLPPVDNSSVGTNGSAVAVESEVVKVQSSFVDPRWVAGTWDLKQFQKNGTTDWDAVIDAEARRRKWLEDNPESSSNENPVVFDTSIVPWWAWMKRFHLPEAELLNGRAAMIGFFMAYFVDSLTGVGLVDQMSNFFCKTLLFVAVLGVLLIRKNEDLENLKKLFDETTLYDKQWQATWQDENSSTSKNE

SEQ ID NO: 7050 - DNA, 1190 bp, Arabidopsis thaliana
  misc_feature (1)..(1190): useful for making plants with modified plant phenotypes as described in USSN 12/139,269
  misc_feature (1)..(1190): Ceres CLONE ID no. 34480
  misc_feature (1)..(1190): Also known as  Ceres CDNA ID no. 23384551
  misc_feature (703)..(703): m is a or c
ctctttagcaaaaaatctcagaactcaaaaaaaaaacatccaacaccaaagacaatggagatgagtttgcgtctcgcttcatcttcaacctcaaacccaatttgtctactaaaccctggaaaaaaccttaatttcccaatccgaaaccatagaatccctaaaacttcgaaacccttttgcgttaggtcttcaatgagcttgtctaaaccacccagacaaaccttatctagtaactgggatgtatctagcttctccattgattccgttgctcaatctccttcaagactcccaagtttcgaagaactcgataccaccaacatgttgctccgtcaaagaatcgtctttttgggttctcaggttgatgatatgacggcggatttggttataagtcagctattgttactagatgctgaggactcagaaagagacattacgctttttatcaattcacccggtggatctattactgctgggatgggaatatatgatgcaatgaaacaatgtaaggcggatgtatctactgtttgcttagggttagctgcatctatgggtgcgtttcttcttgcttctggttcaaaagggaaacggtattgtatgcctaactctaaagttatgatccatcagccacttggtactgctggaggcaaagcaacggaaatgagcatacgtataagagaaatgatgtaccacaagattaaacttmacaaaatcttctctagaatcactgggaagcctgaatcagagatcgaaagtgacacagaccgtgataacttcttgaatccatgggaggcgaaagaatatggtttgatcgacgctgtaatcgatgatgggaaaccgggactaatcgctccaattggagatggtactcctcctcctaaaaccaaagtctgggatctttggaaagtcgaaggaaccaagaaagacaacactaacttgccatctgagcgctccatgacacagaatggttatgccgccattgaatagaactgttgttgcagcgtttacgccttttatatgttattctggtggtacctgtaaccatataacgttgcatttcctgtgtttgtaccatttctctgatagatttttggaataatttgaaggcaaaagatagattatttgttgtagaagaagctacaaaatttaatgattaaattgaatcatcaagccatgagaagctttgtgttttc

SEQ ID NO: 7051 - protein, 309 aa, Arabidopsis thaliana
  misc_feature (1)..(309): useful for making plants with modified plant phenotypes as described in USSN 12/139,269
  misc_feature (80)..(259): Pfam Name: CLP_protease; Pfam Description: Clp protease
  misc_feature (80)..(259): Pfam Name: CLP_protease; Pfam Description: Clp protease
  misc_feature (1)..(309): Utility: Useful for making lethal plants for genetic confinement systems
  misc_feature (1)..(309): Utility: Useful for making smaller plants
MEMSLRLASSSTSNPICLLNPGKNLNFPIRNHRIPKTSKPFCVRSSMSLSKPPRQTLSSNWDVSSFSIDSVAQSPSRLPSFEELDTTNMLLRQRIVFLGSQVDDMTADLVISQLLLLDAEDSERDITLFINSPGGSITAGMGIYDAMKQCKADVSTVCLGLAASMGAFLLASGSKGKRYCMPNSKVMIHQPLGTAGGKATEMSIRIREMMYHKIKLNKIFSRITGKPESEIESDTDRDNFLNPWEAKEYGLIDAVIDDGKPGLIAPIGDGTPPPKTKVWDLWKVEGTKKDNTNLPSERSMTQNGYAAIE

SEQ ID NO: 7052 - protein, 279 aa, Arabidopsis thaliana
  misc_feature (1)..(279): useful for making plants with modified plant phenotypes as described in USSN 12/139,269
  misc_feature (1)..(279): Public GI no. 17028170
  misc_feature (1)..(279): Utility: Useful for making lethal plants for genetic confinement systems
  misc_feature (1)..(279): Utility: Useful for making smaller plants
IPKRAKPFCVRSSMNMSGPRPRPRQTLSSNWDLSNFSVDSVAQSPSRLPSFEELDTTNMLLRQRIVFLGSQVDDMTADLVISQLLLLDAQDSERDITLFINSPGGSITAGMGIYDAMKQCKADVSTVCLGIAASMGAFLLASGSKGKRYCMPNSKVMIHQPLGSAGGKATEMSIRVREMMYHKIKLNKIFSRITGKPESEIEGDTDRDYFLNPWEAKEYGLVDAVIDDGKPGLVAPIGDGTPPPNTKVWDFWKVEGTKNDNKDLPTEQSRVQNGYATPE

SEQ ID NO: 7053 - protein, 313 aa, Arabidopsis thaliana
  misc_feature (1)..(313): useful for making plants with modified plant phenotypes as described in USSN 12/139,269
  misc_feature (1)..(313): Public GI no. 15864561
  misc_feature (1)..(313): Utility: Useful for making lethal plants for genetic confinement systems
  misc_feature (1)..(313): Utility: Useful for making smaller plants
MEMSLNLVSSSSSNHVFLFNPILSGKQLSFPSRHQRIPKRAKPFCVRSSMNLSGPRPRQTLSSDWDVSKFSVDSVAQSPSRLPSFEELDTTNMLLRQRIVFLGSQVDDMTADLVISQLLLLDAQDSERDITLFINSPGGSITAGMGIYDAMKQCKADVSTVCLGLAASMGAFLLASGSKGKRYCMPNSKVMIHQPLGSAGGKATEMSIRVREMMYHKIKLNKIFSRITGKPESEIEGDTDRDYFLNPWEAKEYGLVDAVIDDGKPGLVAPIGDGTPPPNTKVWDFWKVEGTKNDNKDLPTEQSRVQNGYATPE

SEQ ID NO: 7054 - protein, 311 aa, Brassica napus
  misc_feature (1)..(311): useful for making plants with modified plant phenotypes as described in USSN 12/139,269
  misc_feature (1)..(311): Ceres CLONE ID no. 1110310
  misc_feature (1)..(311): Utility: Useful for making lethal plants for genetic confinement systems
  misc_feature (1)..(311): Utility: Useful for making smaller plants
MSLNLVSSSSSNHVFLFNPILSGKQLSFPSRHQRIPKRAKPFCVRSSMNLSGPRPRQTLSSDWDVSKFSVDSVAQSPSRLPSFEELDTTNMLLRQRIVFLGSQVDDMTADLVISQLLLLDAQDSERDITLFINSPGGSITAGMGIYDAMKQCKADVSTVCLGLAASMGAFLLASGSKGKRYCMPNSKVMIHQPLGSAGGKATEMSIRVREMMYHKIKLNKIFSRITGKPESEIEGDTDRDYFLNPWEAKEYGLVDAVIDDGKPGLVAPIGDGTPPPNTKVWDFWKVEGTKNDNKDLPTEQSRVQNGYATPE

SEQ ID NO: 7055 - protein, 313 aa, Brassica napus
  misc_feature (1)..(313): useful for making plants with modified plant phenotypes as described in USSN 12/139,269
  misc_feature (1)..(313): Public GI no. 7657879
  misc_feature (1)..(313): Utility: Useful for making lethal plants for genetic confinement systems
  misc_feature (1)..(313): Utility: Useful for making smaller plants
  misc_feature (292)..(292): Xaa is any aa, unknown or other
MEMSLNLVSSSSSNHVFLFNPILSGKQLSFPSRHQRIPKRAKPFCVRSSMNLSGPRPRQTLSSDWDVSKFSVDSVAQSPSRLPSFEELDTTNMLLRQRIVFLGSQVDDMTADLVISQLLLLDAQDSERDITLFINSPGGSITAGMGIYDAMKQCKADVSTVCLGLAASMGAFLLASGSKGKRYCMPNSKVMIHQPLGSAGGKATEMSIRVREMMYHKIKLNKIFSRITGKPESEIEGDTDRDYFLNPWEAKEYGLVDAVIDDGKPGLVAPIGDGTPPPNTKVWDFWKVEGTXNDNKDLPTEQSRVQNGYATPE

SEQ ID NO: 7056 - protein, 311 aa, Brassica napus
  misc_feature (1)..(311): useful for making plants with modified plant phenotypes as described in USSN 12/139,269
  misc_feature (1)..(311): Public GI no. 6069464
  misc_feature (1)..(311): Utility: Useful for making lethal plants for genetic confinement systems
  misc_feature (1)..(311): Utility: Useful for making smaller plants
MSLNLVSSSSSNRVFLFNPILSGKQVSLPSRHQRIPKRAKPFCVRSSMNLSGSRPRQTLSSNWDVSKFSVDSVAQSPSRLPSFEELDTTNMLLRQRIVFLGSQVDDMTADLVISQLLLLDAQDSERDITLFINSPGGSITAGMGIYDAMKQCKADVSTVCLGLAASMGAFLLASGSKGKRYCMPNSKVMIHQPLGSAGGKATEMSIRVREMMYHKIKLNKIFSRITGKPESEIEGDTDRDYFLNPWEAKEYGLVDAVIDDGKPGLVAPIGDGTPPPNTKVWDFWKVEGTKNDNKDLPTEQSRVQNGYATPE

SEQ ID NO: 7057 - protein, 308 aa, Brassica napus
  misc_feature (1)..(308): useful for making plants with modified plant phenotypes as described in USSN 12/139,269
  misc_feature (1)..(308): Public GI no. 56201842
  misc_feature (1)..(308): Utility: Useful for making lethal plants for genetic confinement systems
  misc_feature (1)..(308): Utility: Useful for making smaller plants
MAALPASPCSSSSSPSSLFLAPNPCCWKAAPRATVRASASAARRTLSSAWELPGPSAARPAARKPRLEELDTTNMLLRQRIVFLGSPVDDMSADLIISQLLLLDAEDKTKDIKLFINSPGGSITAGMGVYDAMKFCKADISTVCFGLAASMGAFLLAAGTKGKRFCMPNARIMIHQPSGGAGGKVTEMGLQIREMMYEKIKINKILSRITGKPEEQIDEDTKFDYFMSPWEAKDYGIVDSVIDEGKPGLVAPLAGAVPPPKSRVWYLWNASGPTRKIMKNLPSEEKLIQNGNGSASGDDGKFKEISTA

SEQ ID NO: 7058 - DNA, 1389 bp, Arabidopsis thaliana
  misc_feature (1)..(1389): useful for making plants with modified plant phenotypes as described in USSN 12/139,269
  misc_feature (1)..(1389): Ceres CLONE ID no. 38625
  misc_feature (1)..(1389): Also known as  Ceres CDNA ID no. 23372163
  misc_feature (165)..(165): k is g or t/u
  misc_feature (166)..(166): k is g or t/u
  misc_feature (924)..(924): d is a or g or t/u
  misc_feature (950)..(950): w is a or t/u
aaaaaaatcccaaaaagcttcgttcttttttagtcatcatcatcttcttcttttcttcttcttcggttgctaaatcggagatggcgactgctctggtttctcctcttacttcacaactcaaccatgaagctgtctgttccaagtttgtgttacccaaatcgccgkkcatatcgggatctaagctcttttcatcgaacatgccttgctctactgttcctagacgcacaagaagatcacactgctttgcttctgctaaagatatgagctttgaccatatccctaaacaatttcgtggagacaatctcaaagacggagtgatgcagaacttcaagaacgtaccgcaatatttttacgggcttaattcagctcaaatggatatgttcatgacagaagatagccctgtccgtaggcaagcggaaaaagttacagaggaaagcatctcgtctagaaataactatttgaacaatggaggaatatggagtatatccggtatgaatgcagcagatgctagaagatatagcatgagtgtccagatgtacagaggtggaggtggcggcggaggatctgaaagaccaagaactgctcctccagatttgccttctttgctattggatgctcgcatatgctaccttggcatgccaatcgtacctgcagttactgagttactcgttgctcaatttatgtggttagactatgataacccaacaaagcccatctacctatatataaattcacccgggacccagaatgagaagatggaaactgttggatcagaaacagaggcttatgccatagccgatactatttcttattgcaaatcagatgtatacactatcaattgtggcatggcttttggtcaagcagcaatgcttctttctctcgggaaaaaaggttatcgtgccgtacaaccacattcatcaacadaattatatctgccaaaagtaaacagwtcgagtggagctgccatagacatgtggataaaggccaaggaacttgatgcaaataccgagtactacatcgagctgttagctaagggaacagggaaatccaaagagcagatcaacgaggacatcaagcgacctaaatatctccaagctcaagcagccattgactatggaattgcagacaagatagctgactcgcaggacagttctttcgagaaacgggattacgatgggacccttgcccagagagctatgagacctggaggaggcagtccagcagctccagccggactaagatgatcaattcccaccagaaagaaagaggttgaatcctaatttcctagtcactctggaatatgtagctcttacaatctataagcaaacacatgtggtagtaacatacaaaaaagtgttggcaaaaagggaaataacatcaaaagttatc

SEQ ID NO: 7059 - protein, 387 aa, Arabidopsis thaliana
  misc_feature (1)..(387): useful for making plants with modified plant phenotypes as described in USSN 12/139,269
  misc_feature (293)..(355): Pfam Name: CLP_protease; Pfam Description: Clp protease
  misc_feature (1)..(387): Utility: Useful for making lethal plants for genetic confinement systems
MATALVSPLTSQLNHEAVCSKFVLPKSPFISGSKLFSSNMPCSTVPRRTRRSHCFASAKDMSFDHIPKQFRGDNLKDGVMQNFKNVPQYFYGLNSAQMDMFMTEDSPVRRQAEKVTEESISSRNNYLNNGGIWSISGMNAADARRYSMSVQMYRGGGGGGGSERPRTAPPDLPSLLLDARICYLGMPIVPAVTELLVAQFMWLDYDNPTKPIYLYINSPGTQNEKMETVGSETEAYAIADTISYCKSDVYTINCGMAFGQAAMLLSLGKKGYRAVQPHSSTKLYLPKVNRSSGAAIDMWIKAKELDANTEYYIELLAKGTGKSKEQINEDIKRPKYLQAQAAIDYGIADKIADSQDSSFEKRDYDGTLAQRAMRPGGGSPAAPAGLR

SEQ ID NO: 7060 - protein, 372 aa, Glycine max
  misc_feature (1)..(372): useful for making plants with modified plant phenotypes as described in USSN 12/139,269
  misc_feature (1)..(372): Ceres CLONE ID no. 576522
  misc_feature (1)..(372): Utility: Useful for making lethal plants for genetic confinement systems
MSSFLSLSLSAPSLHDSSFLHGTKLFPFSRRVAPRRFNSSSAKCSLDHIPKQFRKENLKDGLMENYKNAPQSLYGLSPSQMDMFMTEDNPIRQQSERVTEESISSAKNYMDNGGMWSLSGMGKSDASKYSMSVSMYRGGRGTGRPKTAPPDLPSLLLDARICYLGMPIVPAVTELIVAQFMWLDYDNPSKPIYLYINSSGTLNEKNETVGSETEAYSIADMMSYVKADVYTVNCGMAFGQAAMLLSLGTKGYRAVQPNSSTKLYLPKVNRSSGAVIDMWIKAKELEANTEYYIELLAKGTGKSKEEIAKDVQRPKYLQAQDAIDYGIADKIIDSSSRDVAFEKRNYDEMLAQSRAMRRQGGGNPQAAPSGFR

SEQ ID NO: 7061 - protein, 386 aa, Glycine max
  misc_feature (1)..(386): useful for making plants with modified plant phenotypes as described in USSN 12/139,269
  misc_feature (1)..(386): Public GI no. 50932981
  misc_feature (1)..(386): Utility: Useful for making lethal plants for genetic confinement systems
MALALRCPAAASPSPAKSTFPPSSSPPPSRLPRRPPASCRCYYYGDGGGFRKNYDHIPKQFREENLKDGLMDNYKNVPQFLYGLSPAQIEMFMNDDNPYDRQSQRVTEESISASRSYDEFGMYNLSGMHEGPAGYSMGMGMGTMSMGRAGRGYRRMRSSAPDLPSLLLDSRIIFLGMPIVPAVTELIAAQFLWLDYDDRTKPIYLYINSTGTMDENNELVASETDAFAIADFINRSKSKVYTINLSMAYGQAAMLLSLGVKGKRGVLPNSITKLYLPKVHKSGGAAIDMWIKAKELDTNTDYYLELLSKGVGKPKEELAEFLKGPRYFRAQEAIDYGLADTILHSLDGSFKPKDLTAQLAKAQEMRQSGKRPAAGAGRWSTPSVPR

SEQ ID NO: 7062 - protein, 388 aa, Zea mays
  misc_feature (1)..(388): useful for making plants with modified plant phenotypes as described in USSN 12/139,269
  misc_feature (1)..(388): Ceres CLONE ID no. 381453
  misc_feature (1)..(388): Utility: Useful for making lethal plants for genetic confinement systems
MALALRCPPAATSSRSPFLPSTSPAPAGKVPRRPPASWRCLAYYGDGGFRKNYDHIPKQFREENLKDGLMDNYKHVPQFLYGLSAAQMEMFMNDDNPYNRQSQKVTEESVSAARSYDEFGMYTLSGMHEGPASYSMGMGMGGSMSMSMGRGGRGYRRMRSSAPDLPSLLLDSRIIFLGMPIVPAVTELIAAQFLWLDYDDRTKPIYLYINSTGTMDENNELVASETDAYAIADFINRSKSKVYTINLSMAYGQAAMLLSLGVKGKRGVLPNSITKLHLPKVHKSGGAAIDMWIKAKELDTNTDYYLELLSKGVGKPKEELAEFLRGPRYFRAQEALDYGLADTILHSLDGSFKPKDLTAQLAKAQAMRQSGKRAAAGAGRWSTPTAPR

SEQ ID NO: 7063 - protein, 385 aa, Triticum aestivum
  misc_feature (1)..(385): useful for making plants with modified plant phenotypes as described in USSN 12/139,269
  misc_feature (1)..(385): Ceres CLONE ID no. 764831
  misc_feature (1)..(385): Utility: Useful for making lethal plants for genetic confinement systems
MALALRCPAAASPSRAPFPNSSSHSQSAARPARRPAGGCRCQYYHGDAPPRSYDHIPKQFREENLKDGLMDNYKNVPQFLYGLSPSQMEMFTTDDNPYNRQSKKVTEESVAALRSYDEFGMYSLSGTHEGPANYSMGMGMPSMSMGRAGKGYRRMRSSAPDLPSLLLDSRIIFLGMPIVPAVTELIAAQFLWLDYDDRTKPIYLYINSTGTMDENNELVASETDAYAIADFINRSKAKVYTINLSMAYGQAAMLLSLGMKGKRGVLPNSITKLHLPKVHKSGGAAIDMWIKAKELETNTDYYLELVSQGVGKPKEELAEFLRGPRYFRAQEAIDYGLADTILHSLDGSFKPKDLTAQLAKAQEMRQSGKRAPAGAGRWSTPTAPR

SEQ ID NO: 7064 - DNA, 1304 bp, Arabidopsis thaliana
  misc_feature (1)..(1304): useful for making plants with modified plant phenotypes as described in USSN 12/139,269
  misc_feature (1)..(1304): Ceres CLONE ID no. 39351
  misc_feature (1)..(1304): Also known as  Ceres CDNA ID no. 23655617
atctcctctgctaccttaagctgagagagtcacagtctcgtctctatctctcctctttgcctttttccactcactacacgccaaacccgacgacatggcagctacctctctcactgcccctccttctttctccggtctccgccgcatttctcccaagctcgacgctgccgccgtctcctcccaccaatccttcttccaccgcgtcaattcctctacccgtctcgtttcttcctcttcttcttctcatcgctctcccagaggtgttgttgccatggctggatccggaaagtttttcgttggaggaaactggaagtgtaacgggactaaggactccatcgccaagcttatctccgatctcaacagtgcaaccttggaagcagatgtagatgttgttgtgtcacctccatttgtctacatcgaccaggtcaaatcctcgttgacagaccgtattgacatatcaggtcagaactcttgggttgggaaaggtggagccttcactggtgaaatcagcgtggaacagctcaaagaccttggctgcaagtgggtcattcttgggcattccgaacggagacatgtcatcggagaaaaagatgagtttatcgggaagaaagctgcatatgcattgagtgagggtcttggagtgatagcttgtattggggaaaagctagaagagagggaagcaggcaagacgtttgatgtttgcttcgcgcaactgaaggcgtttgctgatgctgtgcctagctgggacaatatagttgttgcatacgagcctgtatgggcaattggaactggtaaagttgcatctcctcagcaagcacaagaagtccatgtagctgtccgcggttggctaaagaagaatgtctctgaggaagttgcttccaaaacgagaatcatatatggaggttctgtcaatggaggcaacagtgcagagcttgccaaagaagaagacattgatggatttcttgttggtggtgcctccttgaagggtcctgagtttgcaaccattgtgaactcagtcacgtcgaagaaagttgctgcttgattgagaactatcagtaacggaaatcgctagtctccatggaacagatgagatgagaaataaaagggaggttagcgaccttgttgttgttgttgtgttcttacatcttcttcttgaactaataatggaaaacagaaagaaaaaaaatgattcgtgagctctggtttgacagagagagataaaagggtctttgattaaagatctttgtaactaagctgtgattctttttttcaatttgagtaagcttgactcacgagtttcttct

SEQ ID NO: 7065 - protein, 315 aa, Arabidopsis thaliana
  misc_feature (1)..(315): useful for making plants with modified plant phenotypes as described in USSN 12/139,269
  misc_feature (66)..(305): Pfam Name: TIM; Pfam Description: Triosephosphate isomerase
  misc_feature (66)..(305): Pfam Name: TIM; Pfam Description: Triosephosphate isomerase
  misc_feature (1)..(315): Utility: Useful for making lethal plants for genetic confinement systems
  misc_feature (1)..(315): Utility: Useful for making plants sterile and for genetic confinement
  misc_feature (1)..(315): Utility: Useful for making plants with increased biomass and foliage
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNIVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 7066 - protein, 256 aa, Glycine max
  misc_feature (1)..(256): useful for making plants with modified plant phenotypes as described in USSN 12/139,269
  misc_feature (1)..(256): Ceres CLONE ID no. 1016565
  misc_feature (1)..(256): Utility: Useful for making lethal plants for genetic confinement systems
  misc_feature (1)..(256): Utility: Useful for making plants sterile and for genetic confinement
  misc_feature (1)..(256): Utility: Useful for making plants with increased biomass and foliage
MAGSGKFFVGGNWKCNGTKESISKLVSDLNAATLESDVDVVVAPPFIYIDQVKSSLTGRIEVSAQNTWIGKGGAFTGEISAEQLVDIGCQWVILGHSERRHVIGEDDEFIGKKAAYALSQNLKVMACIGELLEEREAGKTFDVCFKQMKAFADNITDWTNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 7067 - protein, 304 aa, Zea mays
  misc_feature (1)..(304): useful for making plants with modified plant phenotypes as described in USSN 12/139,269
  misc_feature (1)..(304): Ceres CLONE ID no. 687466
  misc_feature (1)..(304): Utility: Useful for making lethal plants for genetic confinement systems
  misc_feature (1)..(304): Utility: Useful for making plants sterile and for genetic confinement
  misc_feature (1)..(304): Utility: Useful for making plants with increased biomass and foliage
  misc_feature (146)..(146): Xaa is any aa, unknown or other
MAAAPSSLVSSHLSRLADLRRAAAPATPTVPQQLRVGCSRRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSXRRHIIGENDEFIGKKAAYALSQNVKVIACIGELLEEREAGKTFEVCFEQMKAFADSISNWADVVIAYEPVWAIGTGKVATPEQAQEVHAAVRDWLTTNISPDVASSTRIIYGGSVNAANCAELSKKEDIDGFLVGGASLKAPDFATIINSVTAKKVAA

SEQ ID NO: 7068 - protein, 298 aa, Zea mays
  misc_feature (1)..(298): useful for making plants with modified plant phenotypes as described in USSN 12/139,269
  misc_feature (1)..(298): Ceres CLONE ID no. 343468
  misc_feature (1)..(298): Utility: Useful for making lethal plants for genetic confinement systems
  misc_feature (1)..(298): Utility: Useful for making plants sterile and for genetic confinement
  misc_feature (1)..(298): Utility: Useful for making plants with increased biomass and foliage
MAAAPSSLASSHLSPIAAVSTPAVPHQLRIGCSRRRAGRIVAMAGSGKFFVGGNWKCNGTKDSISKLVSELNAATLETDVDVVVAPPFIYIDQVKNSLTGRIEVSAQNVWIGKGGAYTGEISAEQLVDIGCQWVILGHSERRHIIGENDEFIGKKAAYALSHCVGVIACIGELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 7069 - protein, 253 aa, Zea mays
  misc_feature (1)..(253): useful for making plants with modified plant phenotypes as described in USSN 12/139,269
  misc_feature (1)..(253): Ceres CLONE ID no. 985017
  misc_feature (1)..(253): Utility: Useful for making lethal plants for genetic confinement systems
  misc_feature (1)..(253): Utility: Useful for making plants sterile and for genetic confinement
  misc_feature (1)..(253): Utility: Useful for making plants with increased biomass and foliage
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMEVVAAQTKAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 7070 - protein, 250 aa, Zea mays
  misc_feature (1)..(250): useful for making plants with modified plant phenotypes as described in USSN 12/139,269
  misc_feature (1)..(250): Ceres CLONE ID no. 213850
  misc_feature (1)..(250): Utility: Useful for making lethal plants for genetic confinement systems
  misc_feature (1)..(250): Utility: Useful for making plants sterile and for genetic confinement
  misc_feature (1)..(250): Utility: Useful for making plants with increased biomass and foliage
MGRKFFVGGNWKCNGTADQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 7071 - protein, 253 aa, Glycine max
  misc_feature (1)..(253): useful for making plants with modified plant phenotypes as described in USSN 12/139,269
  misc_feature (1)..(253): Ceres CLONE ID no. 463478
  misc_feature (1)..(253): Utility: Useful for making lethal plants for genetic confinement systems
  misc_feature (1)..(253): Utility: Useful for making plants sterile and for genetic confinement
  misc_feature (1)..(253): Utility: Useful for making plants with increased biomass and foliage
MGRKFFVGGNWKCNGTTEEVKKIVTTLNEAKVPGEDVVEVVVSPPFVFLPFVKSLLRPDFHVSAQNCWVRKGGAYTGEVSAEMLVNLGIPWVIIGHSERRQLLNESNEFVGDKVAYALQQGLKVIACIGETLEQREAGTTTAVVAEQTKAIAAKISNWDNVVLAYEPVWAIGTGKVATPAQAQEVHADLRKWVHDNVSAEVAASVRIIYGGSVNGGNCKELAAQPDVDGFLVGGASLKAEFVDIINAATVKKN

SEQ ID NO: 7072 - protein, 253 aa, Glycine max
  misc_feature (1)..(253): useful for making plants with modified plant phenotypes as described in USSN 12/139,269
  misc_feature (1)..(253): Ceres CLONE ID no. 1058593
  misc_feature (1)..(253): Utility: Useful for making lethal plants for genetic confinement systems
  misc_feature (1)..(253): Utility: Useful for making plants sterile and for genetic confinement
  misc_feature (1)..(253): Utility: Useful for making plants with increased biomass and foliage
  misc_feature (137)..(137): Xaa is any aa, unknown or other
  misc_feature (140)..(140): Xaa is any aa, unknown or other
  misc_feature (145)..(145): Xaa is any aa, unknown or other
  misc_feature (148)..(148): Xaa is any aa, unknown or other
  misc_feature (180)..(180): Xaa is any aa, unknown or other
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREXGSXMAVVXEQXKAIAGKIKDWTNVVVAYEPVWAIGTGKVATPXQAQEVHANLRDWLKTNVSPEVAESTRIIYGGSVTGASCKELAGQPDVDGFLVGGASLKPEFIDIINAATVKSA

SEQ ID NO: 7073 - DNA, 1119 bp, Arabidopsis thaliana
  misc_feature (1)..(1119): useful for making plants with modified plant phenotypes as described in USSN 12/139,269
  misc_feature (1)..(1119): Ceres CLONE ID no. 153053
  misc_feature (1)..(1119): Also known as  Ceres CDNA ID no. 23370821
aactctgcaaaagaaaaaaaaactcagagcagaggagatcgagagagacaaagagagacaaagagagagagagagagagagagagagagagagagagagagatcttcaacaagcaatgtctatatccatggcgttattctctccgccgatctcttcctcacttcaaaaccctaatctcatccccaagatctcaacctctcttctctccaccaaacgtttctctctaatctccgtccctagagcttcctccgacaatggtacgacttcccccgtcgtgaaaattccgaagcctgcgtctgtagctgtagaggaagttccggttaaatctccggcggaaagctcctccgcttctgaaaacggcgccgttggaggtgaagcgactgattcgagtactgagacggtaatcaaatatcaaaatgcgaagtgggttaatggaacttgggatctgaaacagttcgagaaagatggcaaaactgattgggattctgttatcgtttctgaggcaaagaggagaaaatggcttgaagataacccggaaacaacgagtaacgacgagcttgttgtcttcgatacttcgattattccatggtgggcatggatgaagagataccatctacctgaagctgaacttctcaatggtcgtgctgcgatgatagggttcttcatggcttactttgttgatagtcttaccggagtaggacttgttgatcaaatggggaatttcttctgcaaaacactcttgtttgtggctgtagctggagttctcttcatccgtaagaatgaagatttagacaaacttaaggatctgttcgatgagactacgttatatgacaaacaatggcaagctgcatggaaagagccagattcatcaacagtttcttcaaagaagtgaacaagttcttacaatctttcattttcctttttttgttatgcaataatctgtgaatcagtgaaagtttatctctactgaactactgatcttcagattttgtaatctttctgctttaaaaatctctatgaagtagtctcaaagataatgtatcgaaggtctttgacttgtaaagcagacctatttcgttttgacgcttgataatttaatcaataagagatttttttttt

SEQ ID NO: 7074 - protein, 258 aa, Arabidopsis thaliana
  misc_feature (1)..(258): useful for making plants with modified plant phenotypes as described in USSN 12/139,269
  misc_feature (1)..(258): Utility: Useful for making lethal plants for genetic confinement systems
MSISMALFSPPISSSLQNPNLIPKISTSLLSTKRFSLISVPRASSDNGTTSPVVKIPKPASVAVEEVPVKSPAESSSASENGAVGGEATDSSTETVIKYQNAKWVNGTWDLKQFEKDGKTDWDSVIVSEAKRRKWLEDNPETTSNDELVVFDTSIIPWWAWMKRYHLPEAELLNGRAAMIGFFMAYFVDSLTGVGLVDQMGNFFCKTLLFVAVAGVLFIRKNEDLDKLKDLFDETTLYDKQWQAAWKEPDSSTVSSKK

SEQ ID NO: 7075 - protein, 170 aa, Arabidopsis thaliana
  misc_feature (1)..(170): useful for making plants with modified plant phenotypes as described in USSN 12/139,269
  misc_feature (1)..(170): Ceres CLONE ID no. 29150
  misc_feature (1)..(170): Utility: Useful for making lethal plants for genetic confinement systems
MKTTESVIKFQDARWINGTWDLKQFEKDGKTDWDSVIVAEAKRRKWLEENPETTSNDEPVLFDTSIIPWWAWIKRYHLPEAELLNGRAAMIGFFMAYFVDSLTGVGLVDQMGNFFCKTLLFVAVAGVLFIRKNEDVDKLKNLFDETTLYDKQWQAAWKNDDDESLGSKKK

SEQ ID NO: 7076 - protein, 170 aa, Arabidopsis thaliana; identical to SEQ ID NO: 7075
  misc_feature (1)..(170): useful for making plants with modified plant phenotypes as described in USSN 12/139,269
  misc_feature (1)..(170): Ceres CLONE ID no. 1334525
  misc_feature (1)..(170): Utility: Useful for making lethal plants for genetic confinement systems

SEQ ID NO: 7077 - protein, 262 aa, Glycine max; identical to SEQ ID NO: 7049
  misc_feature (1)..(262): useful for making plants with modified plant phenotypes as described in USSN 12/139,269
  misc_feature (1)..(262): Ceres CLONE ID no. 470787
  misc_feature (1)..(262): Utility: Useful for making lethal plants for genetic confinement systems

SEQ ID NO: 7078 - DNA, 1131 bp, Arabidopsis thaliana
  misc_feature (1)..(1131): useful for making plants with modified plant phenotypes as described in USSN 12/139,269
  misc_feature (1)..(1131): Ceres CLONE ID no. 159318
  misc_feature (1)..(1131): Also known as  Ceres CDNA ID no. 23370821
acacattcaaactaactctgcaaaagaaaaaaaaactcagagcagaggagatcgagagagacaaagagagacaaagagagagagagagagagagagagagagagagagagagagatcttcaacaagcaatgtctatatccatggcgttattctctccgccgatctcttcctcacttcaaaaccctaatctcatccccaagatctcaacctctcttctctccaccaaacgtttctctctaatctccgtccctagagcttcctccgacaatggtacgacttcccccgtcgtgaaaattccgaagcctgcgtctgtagctgtagaggaagttccggttaaatctccggcggaaagctcctccgcttctgaaaacggcgccgttggaggtgaagcgactgattcgagtactgagacggtaatcaaatatcaaaatgcgaagtgggttaatggaacttgggatctgaaacagttcgagaaagatggcaaaactgattgggattctgttatcgtttctgaggcaaagaggagaaaatggcttgaagataacccggaaacaacgagtaacgacgagcttgttgtcttcgatacttcgattattccatggtgggcatggatgaagagataccatctacctgaagctgaacttctcaatggtcgtgctgcgatgatagggttcttcatggcttactttgttgatagtcttaccggagtaggacttgttgatcaaatggggaatttcttctgcaaaacactcttgtttgtggctgtagctggagttctcttcatccgtaagaatgaagatttagacaaacttaaggatctgttcgatgagactacgttatatgacaaacaatggcaagctgcatggaaagagccagattcatcaacagtttcttcaaagaagtgaacaagttcttacaatctttcattttcctttttttgttatgcaataatctgtgaatcagtgaaagtttatctctactgaactactgatcttcagattttgtaatctttctgctttaaaaatctctatgaagtagtctcaaagataatgtatcgaaggtctttgacttgtaaagcagacctatttcgttttgacgcttgataatttaatcaataagagattttttttt

SEQ ID NO: 7079 - protein, 258 aa, Arabidopsis thaliana; identical to SEQ ID NO: 7074
  misc_feature (1)..(258): useful for making plants with modified plant phenotypes as described in USSN 12/139,269
  misc_feature (1)..(258): Utility: Useful for making lethal plants for genetic confinement systems
  misc_feature (1)..(258): Utility: Useful for making smaller plants

SEQ ID NO: 7080 - protein, 101 aa, Brassica napus
  misc_feature (1)..(101): useful for making plants with modified plant phenotypes as described in USSN 12/139,269
  misc_feature (1)..(101): Ceres CLONE ID no. 872284
  misc_feature (1)..(101): Utility: Useful for making lethal plants for genetic confinement systems
  misc_feature (1)..(101): Utility: Useful for making smaller plants
MKRYHLPEAELLNGRAAMIGFFMAYFVDSLTGVGLVDQMGNFFCKTLLFVAVAGVLFIRKNEDLDKLKGLIEETTLYDKQWQAAWKEPESSSSSSTVSSKK

SEQ ID NO: 7081 - protein, 170 aa, Arabidopsis thaliana; identical to SEQ ID NO: 7075
  misc_feature (1)..(170): useful for making plants with modified plant phenotypes as described in USSN 12/139,269
  misc_feature (1)..(170): Ceres CLONE ID no. 29150
  misc_feature (1)..(170): Utility: Useful for making lethal plants for genetic confinement systems
  misc_feature (1)..(170): Utility: Useful for making smaller plants

SEQ ID NO: 7082 - protein, 170 aa, Arabidopsis thaliana; identical to SEQ ID NO: 7075
  misc_feature (1)..(170): useful for making plants with modified plant phenotypes as described in USSN 12/139,269
  misc_feature (1)..(170): Ceres CLONE ID no. 1334525
  misc_feature (1)..(170): Utility: Useful for making lethal plants for genetic confinement systems
  misc_feature (1)..(170): Utility: Useful for making smaller plants

SEQ ID NO: 7083 - protein, 262 aa, Glycine max; identical to SEQ ID NO: 7049
  misc_feature (1)..(262): useful for making plants with modified plant phenotypes as described in USSN 12/139,269
  misc_feature (1)..(262): Ceres CLONE ID no. 470787
  misc_feature (1)..(262): Utility: Useful for making lethal plants for genetic confinement systems
  misc_feature (1)..(262): Utility: Useful for making smaller plants

SEQ ID NO: 7084 - DNA, 1024 bp, Zea mays
  misc_feature (1)..(1024): useful for making plants with modified plant phenotypes as described in USSN 12/139,269
  misc_feature (1)..(1024): Ceres CLONE ID no. 241379
  misc_feature (1)..(1024): Also known as  Ceres CDNA ID no. 23764183
ataaattcctccgctccccttcgccgcttcctgtcgcgccgccgctcccctcccaacccactagctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggacggctactctggcgtggaggtgcgcgtcacgccgatgcgcacggagatcatcatccgcgccacgcgcacgcagaacgtgctcggcgagaagggccgtaggatcagggagctcacctccgtcgtccagaagaggttcaacttccctgagaatggcgttgagctttatgccgagaaggtcgtcaaccgtgggctctgtgccatcgcgcaggccgagtccctccgttacaagctcctcggtggccttgccgtccgcagggcttgctacggtgttcttcgttatgttatggagagtggtgccaagggttgtgaggtgatcgtgagtggaaagctcagggcccaaagagccaagtccatgaagttcaaggatggctacatgatctcatctggtcaaccagtgaacgagtacattgactcggctgtgagacacgttcttctcagacagggtgttcttggcatcaaggtgaagatcatgcttgactgggacccgaagggcaaggttggcccgatcactcctcttccggacctggtgaccatccacaccccgaaggacgaggacgagccgcgccctccggtcttggcacctcctgaggtgtaaggtcccaactgtgtccttgaaatggcagtttgatcgggtcctagataggtttctatcttacgataaggacaatgctaaggcagttggttaccttaatctttatggacagatgctatgtgttgcttctgtggcacttttgtttaagctaagttttgcggagacaagatacttatatatgttcccgatgaaattatggttc

SEQ ID NO: 7085 - protein, 229 aa, Zea mays
  misc_feature (1)..(229): useful for making plants with modified plant phenotypes as described in USSN 12/139,269
  misc_feature (45)..(102): Pfam Name: KH_2; Pfam Description: KH domain
  misc_feature (104)..(188): Pfam Name: Ribosomal_S3_C; Pfam Description: Ribosomal protein S3, C-terminal domain
  misc_feature (1)..(229): Utility: Useful for making lethal plants for genetic confinement systems
  misc_feature (1)..(229): Utility: Useful for making ornamental plants with modified flowers
  misc_feature (1)..(229): Utility: Useful for making ornamental plants with modified leaves
  misc_feature (1)..(229): Utility: Useful for making plants with altered leaf shape eg curled leaves
  misc_feature (1)..(229): Utility: Useful for making plants with increased biomass
  misc_feature (1)..(229): Utility: Useful for making plants with increased biomass and foliage
  misc_feature (1)..(229): Utility: Useful for making plants with modified flowers
  misc_feature (1)..(229): Utility: Useful for making smaller plants
  misc_feature (1)..(229): Utility: Useful for modifying plant architecture, ie amount of branching
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRYVMESGAKGCEVIVSGKLRAQRAKSMKFKDGYMISSGQPVNEYIDSAVRHVLLRQGVLGIKVKIMLDWDPKGKVGPITPLPDLVTIHTPKDEDEPRPPVLAPPEV

SEQ ID NO: 7086 - protein, 227 aa, Triticum aestivum
  misc_feature (1)..(227): useful for making plants with modified plant phenotypes as described in USSN 12/139,269
  misc_feature (1)..(227): Ceres CLONE ID no. 1032471
  misc_feature (1)..(227): Utility: Useful for making lethal plants for genetic confinement systems
  misc_feature (1)..(227): Utility: Useful for making ornamental plants with modified flowers
  misc_feature (1)..(227): Utility: Useful for making ornamental plants with modified leaves
  misc_feature (1)..(227): Utility: Useful for making plants with altered leaf shape eg curled leaves
  misc_feature (1)..(227): Utility: Useful for making plants with increased biomass
  misc_feature (1)..(227): Utility: Useful for making plants with increased biomass and foliage
  misc_feature (1)..(227): Utility: Useful for making plants with modified flowers
  misc_feature (1)..(227): Utility: Useful for making smaller plants
  misc_feature (1)..(227): Utility: Useful for modifying plant architecture, ie amount of branching
MATQISKKKKFVSDGVFYAELNEMLTRELAEDGYSGVEVRVTPMRTEIIIRATRTQNVLGEKGRRIRELTSVVQKRFNFLENGVELYAEKVVNRGLCAIAQAESLRYKLLGGLAVRRACYGVLRFVMESGAKGCEVIVSGKLRAQRAKSMKFKDGYMISSGQPVNEYIDAAVRHVLLRQGVLGIKVKIMLDWDPKGKLGPTTPLPDLVTIHPPKEENELRPPALVEV

SEQ ID NO: 7087 - protein, 232 aa, Glycine max
  misc_feature (1)..(232): useful for making plants with modified plant phenotypes as described in USSN 12/139,269
  misc_feature (1)..(232): Ceres CLONE ID no. 467335
  misc_feature (1)..(232): Utility: Useful for making lethal plants for genetic confinement systems
  misc_feature (1)..(232): Utility: Useful for making ornamental plants with modified flowers
  misc_feature (1)..(232): Utility: Useful for making ornamental plants with modified leaves
  misc_feature (1)..(232): Utility: Useful for making plants with altered leaf shape eg curled leaves
  misc_feature (1)..(232): Utility: Useful for making plants with increased biomass
  misc_feature (1)..(232): Utility: Useful for making plants with increased biomass and foliage
  misc_feature (1)..(232): Utility: Useful for making plants with modified flowers
  misc_feature (1)..(232): Utility: Useful for making smaller plants
  misc_feature (1)..(232): Utility: Useful for modifying plant architecture, ie amount of branching
MSKKRKFVADGVFFAELNEVLTRELAEDGYSGVEVRVTPMRTEIIIRATRTQAVLGEKGRRIRELTSVVQKRFKFPENSVELYAEKVNNRGLCAIAQAESLRYKLLGGLAVRRACYGVLRFVMESGAKGCEVIVSGKLRAQRAKSMKFKDGYMIFSGQPVKDYIDSAVRHVLLRQGVLGIKVKIMLDWDPKGKQGPKTPLPDLVTIHTPKEEEEYARPAAVLATNIEVPVAS

SEQ ID NO: 7088 - protein, 232 aa, Zea mays
  misc_feature (1)..(232): useful for making plants with modified plant phenotypes as described in USSN 12/139,269
  misc_feature (1)..(232): Ceres CLONE ID no. 1600660
  misc_feature (1)..(232): Utility: Useful for making lethal plants for genetic confinement systems
  misc_feature (1)..(232): Utility: Useful for making ornamental plants with modified flowers
  misc_feature (1)..(232): Utility: Useful for making ornamental plants with modified leaves
  misc_feature (1)..(232): Utility: Useful for making plants with altered leaf shape eg curled leaves
  misc_feature (1)..(232): Utility: Useful for making plants with increased biomass
  misc_feature (1)..(232): Utility: Useful for making plants with increased biomass and foliage
  misc_feature (1)..(232): Utility: Useful for making plants with modified flowers
  misc_feature (1)..(232): Utility: Useful for making smaller plants
  misc_feature (1)..(232): Utility: Useful for modifying plant architecture, ie amount of branching
MASTHAISKKRKFVAVGVFFAELNEMLTRELAEDGYSGVEVRVTPMRTEIIIRATRTQNVLGEKGRRIRELTSVVQKRFNFPEGGVELYAEKVNNRGLCAIAQAESLRYKLLGGLAVRRACYGVLRFVMESGAKGCEVIVSGKLRAQRAKSMKFKDGYMISSGHPVNLYIDSAVRHVLLRQGVLGIKVKIMLDWDPKGKQGPTMPLPDLVTIHVPKEEDEFLRPLAAEIQVA

SEQ ID NO: 7089 - protein, 219 aa, Glycine max
  misc_feature (1)..(219): useful for making plants with modified plant phenotypes as described in USSN 12/139,269
  misc_feature (1)..(219): Ceres CLONE ID no. 620092
  misc_feature (1)..(219): Utility: Useful for making lethal plants for genetic confinement systems
  misc_feature (1)..(219): Utility: Useful for making ornamental plants with modified flowers
  misc_feature (1)..(219): Utility: Useful for making ornamental plants with modified leaves
  misc_feature (1)..(219): Utility: Useful for making plants with altered leaf shape eg curled leaves
  misc_feature (1)..(219): Utility: Useful for making plants with increased biomass
  misc_feature (1)..(219): Utility: Useful for making plants with increased biomass and foliage
  misc_feature (1)..(219): Utility: Useful for making plants with modified flowers
  misc_feature (1)..(219): Utility: Useful for making smaller plants
  misc_feature (1)..(219): Utility: Useful for modifying plant architecture, ie amount of branching
  misc_feature (64)..(64): Xaa is any aa, unknown or other
  misc_feature (67)..(67): Xaa is any aa, unknown or other
  misc_feature (89)..(89): Xaa is any aa, unknown or other
  misc_feature (95)..(95): Xaa is any aa, unknown or other
  misc_feature (96)..(96): Xaa is any aa, unknown or other
  misc_feature (101)..(101): Xaa is any aa, unknown or other
  misc_feature (211)..(211): Xaa is any aa, unknown or other
MSKKRKFVADGVFFAELNEVLTRELAEDGYSGVEVRVTPMRTEIIIRATRTQAVLGEKGRRIRXLTXVVQKRFKFPENSVELYAEKVNXRGLCAXXQAESXRYKLLGGLAVRRACYGVLRFVMESGAKGCEVIVSGKLRAQRAKSMKFKDGYMISSGQPVKDYIDSAVRHVLLRQGVLGIKVKIMLDWDPKGKQGPKTPLPDLVTIHSPKXEEEYIQPA

SEQ ID NO: 7090 - protein, 207 aa, Arabidopsis thaliana
  misc_feature (1)..(207): useful for making plants with modified plant phenotypes as described in USSN 12/139,269
  misc_feature (1)..(207): Ceres CLONE ID no. 15190
  misc_feature (1)..(207): Utility: Useful for making lethal plants for genetic confinement systems
  misc_feature (1)..(207): Utility: Useful for making ornamental plants with modified flowers
  misc_feature (1)..(207): Utility: Useful for making ornamental plants with modified leaves
  misc_feature (1)..(207): Utility: Useful for making plants with altered leaf shape eg curled leaves
  misc_feature (1)..(207): Utility: Useful for making plants with increased biomass
  misc_feature (1)..(207): Utility: Useful for making plants with increased biomass and foliage
  misc_feature (1)..(207): Utility: Useful for making plants with modified flowers
  misc_feature (1)..(207): Utility: Useful for making smaller plants
  misc_feature (1)..(207): Utility: Useful for modifying plant architecture, ie amount of branching
MRTEIIIRATRTQNVLGEKGRRIRELTSLVQKRFKFPVDSVELYAEKVNNRGLCAIAQAESLRYKLLGGLAVRRACYGVLRFVMESGAKGCEVIVSGKLRAARAKSMKFKDGYMVSSGQPTKEYIDAAVRHVLLRQGVLGIKVKIMLDWDPTGKSGPKTPLPDVVIIHAPKDDVVYSAPAQAAAPVTLVQEAPLTTVDYPEMIPPVA

SEQ ID NO: 7091 - protein, 249 aa, Zea mays
  misc_feature (1)..(249): useful for making plants with modified plant phenotypes as described in USSN 12/139,269
  misc_feature (1)..(249): Ceres CLONE ID no. 1383206
  misc_feature (1)..(249): Utility: Useful for making lethal plants for genetic confinement systems
  misc_feature (1)..(249): Utility: Useful for making ornamental plants with modified flowers
  misc_feature (1)..(249): Utility: Useful for making ornamental plants with modified leaves
  misc_feature (1)..(249): Utility: Useful for making plants with altered leaf shape eg curled leaves
  misc_feature (1)..(249): Utility: Useful for making plants with increased biomass
  misc_feature (1)..(249): Utility: Useful for making plants with increased biomass and foliage
  misc_feature (1)..(249): Utility: Useful for making plants with modified flowers
  misc_feature (1)..(249): Utility: Useful for making smaller plants
  misc_feature (1)..(249): Utility: Useful for modifying plant architecture, ie amount of branching
  misc_feature (57)..(57): Xaa is any aa, unknown or other
MATQISKKRKFVADGVFYAELNEVLTRELAEDGYSGVEVRVTPMRTEIIIRATRTQXVLGEKGRRIRELTSLVQKRFRFPQDSVELYAEKVANRGLCAIAQAESLRYKLLGGLAVRRACYGVLRFVMESGAKGCEVIVSGKLRAARAKSMKFKDGYMVSSGQPTKEYIDSAVRHVLLRQGVLGIKVKVMLDWDPKGVTGPKTPLPDVVIIHSPKEEEVNSAPAQVDAPAAFVPEAPLTAVDYPEMIPVA

SEQ ID NO: 7092 - protein, 206 aa, Arabidopsis thaliana
  misc_feature (1)..(206): useful for making plants with modified plant phenotypes as described in USSN 12/139,269
  misc_feature (1)..(206): Ceres CLONE ID no. 9568
  misc_feature (1)..(206): Utility: Useful for making lethal plants for genetic confinement systems
  misc_feature (1)..(206): Utility: Useful for making ornamental plants with modified flowers
  misc_feature (1)..(206): Utility: Useful for making ornamental plants with modified leaves
  misc_feature (1)..(206): Utility: Useful for making plants with altered leaf shape eg curled leaves
  misc_feature (1)..(206): Utility: Useful for making plants with increased biomass
  misc_feature (1)..(206): Utility: Useful for making plants with increased biomass and foliage
  misc_feature (1)..(206): Utility: Useful for making plants with modified flowers
  misc_feature (1)..(206): Utility: Useful for making smaller plants
  misc_feature (1)..(206): Utility: Useful for modifying plant architecture, ie amount of branching
MRTEIIIRATRTQNVLGEKGRRIRELTSLVQKRFKFPVDSVELYAEKVNNRGLCAIAQAESLRYKLLGGLAVRRACYGVLRFVMESGAKGCEVIVSGKLRAARAKSMKFKDGYMVSSGQPTKEYIDSAVRHVLLRQGVLGIKVKVMLDWDPKGISGPKTPLPDVVIIHSPKEEEAIYAPAQVAAPAALVADAPLTAVDYPAMIPVA

SEQ ID NO: 7093 - protein, 206 aa, Zea mays
  misc_feature (1)..(206): useful for making plants with modified plant phenotypes as described in USSN 12/139,269
  misc_feature (1)..(206): Ceres CLONE ID no. 1062254
  misc_feature (1)..(206): Utility: Useful for making lethal plants for genetic confinement systems
  misc_feature (1)..(206): Utility: Useful for making ornamental plants with modified flowers
  misc_feature (1)..(206): Utility: Useful for making ornamental plants with modified leaves
  misc_feature (1)..(206): Utility: Useful for making plants with altered leaf shape eg curled leaves
  misc_feature (1)..(206): Utility: Useful for making plants with increased biomass
  misc_feature (1)..(206): Utility: Useful for making plants with increased biomass and foliage
  misc_feature (1)..(206): Utility: Useful for making plants with modified flowers
  misc_feature (1)..(206): Utility: Useful for making smaller plants
  misc_feature (1)..(206): Utility: Useful for modifying plant architecture, ie amount of branching
  misc_feature (132)..(132): Xaa is any aa, unknown or other
MRTEIIIRATRTQNVLGEKGRRIRELTSLVQKRFRFPQDSVELYAEKVANRGLCAIAQAESLRYKLLGGLAVRRACYGVLRFVMESGAKGCEVIVSGKLRAARAKSMKFKDGYMVSSGQPTKDYIDSAVRHXLLRQGVLGIKVKVMLDWDPKGINGPKTPLPDVVIIHAPKEEDVNSAPAQVAAPAALAPEAPLTAVDYPEMIPVA

SEQ ID NO: 7094 - protein, 206 aa, Arabidopsis thaliana
  misc_feature (1)..(206): useful for making plants with modified plant phenotypes as described in USSN 12/139,269
  misc_feature (1)..(206): Ceres CLONE ID no. 1208311
  misc_feature (1)..(206): Utility: Useful for making lethal plants for genetic confinement systems
  misc_feature (1)..(206): Utility: Useful for making ornamental plants with modified flowers
  misc_feature (1)..(206): Utility: Useful for making ornamental plants with modified leaves
  misc_feature (1)..(206): Utility: Useful for making plants with altered leaf shape eg curled leaves
  misc_feature (1)..(206): Utility: Useful for making plants with increased biomass
  misc_feature (1)..(206): Utility: Useful for making plants with increased biomass and foliage
  misc_feature (1)..(206): Utility: Useful for making plants with modified flowers
  misc_feature (1)..(206): Utility: Useful for making smaller plants
  misc_feature (1)..(206): Utility: Useful for modifying plant architecture, ie amount of branching
  misc_feature (48)..(48): Xaa is any aa, unknown or other
  misc_feature (111)..(111): Xaa is any aa, unknown or other
MRTEIIIRATRTQNVLGEKGRRIRELTSLVQKRFKFPVDSVELYAEKXNKRGLCAIAQAESLRYKLLGGLAVRRACYGVLRFVMESGAKGCEVIVSGKLRAARAKSMKFKXGYMVSSGQPTKEYIDSAVRHVLLRQGVLGIKVKVMLDWDPKGISGPKTPLPDVVIIHSPKEEEAIYAPAQVAAPAALVADAPLTAVDYPAMIPVA

SEQ ID NO: 7095 - DNA, 1024 bp, Arabidopsis thaliana
  misc_feature (1)..(1024): useful for making plants with modified plant phenotypes as described in USSN 12/139,269
  misc_feature (1)..(1024): Ceres CLONE ID no. 5220
  misc_feature (1)..(1024): Also known as  Ceres CDNA ID no. 23384579
acttcttctagtcttaaaataaaacaaacaaaaaaatcagtgttcggctctaacacgctcgacgaccatggcggtctcgtttaatacaacgcttcaccagccttctctgagtcccagctgtagcatcaagctttattctgggttaaagcctcaatctgcaagctttttggcaagtgggtatcagaatttgaataaggagttctatggaagagttcataagagtctgcaatctgggactggcaaagcgagcaggtcacgggtaaagatgatgccaataggaacaccgagagtgccctacagaaaccgtgaagaaggcacttggcaatgggttgatatatggaatgccctttatcgagagcgtgtaatcttcattggacaaaacattgatgaagagtttagcaaccagatattagcaaccatgttgtaccttgatactcttgatgactcgaggaggatttatatgtacctaaatggtccgggtggtgatcttactccaagtctagccatctatgatacaatgaagagcttgaaaagtccggttgggacacattgcgttgggcttgcttacaaccttgcaggttttcttcttgcggctggagaaaagggtcaccgatttgcgatgccattgtcaagaatcgccctccaatcaccagctggtgcagcccgtggccaggctgatgatatccaaaatgaagcaaaagagctttcaaggataagagactacctcttcaatgaactagccaagaatacaggccagcctgcggaaagggtcttcaaagacttgagccgggtgaaaaggttcaatgcagaggaagcaatcgagtatggacttattgataagattgttagaccaccgcgcatcaaagaagacgctcctcgccaagacgaaagcgcagggctaggctagtcttttttgtttgtttgttatgtcaaaagttttaatctttatgttattgtgattgtgattgttacctaaaaaaatcactgattattgttttttcattccaccgattttctgatttct

SEQ ID NO: 7096 - protein, 279 aa, Arabidopsis thaliana
  misc_feature (1)..(279): useful for making plants with modified plant phenotypes as described in USSN 12/139,269
  misc_feature (79)..(263): Pfam Name: CLP_protease; Pfam Description: Clp protease
  misc_feature (1)..(279): Utility: Useful for making lethal plants for genetic confinement systems
MAVSFNTTLHQPSLSPSCSIKLYSGLKPQSASFLASGYQNLNKEFYGRVHKSLQSGTGKASRSRVKMMPIGTPRVPYRNREEGTWQWVDIWNALYRERVIFIGQNIDEEFSNQILATMLYLDTLDDSRRIYMYLNGPGGDLTPSLAIYDTMKSLKSPVGTHCVGLAYNLAGFLLAAGEKGHRFAMPLSRIALQSPAGAARGQADDIQNEAKELSRIRDYLFNELAKNTGQPAERVFKDLSRVKRFNAEEAIEYGLIDKIVRPPRIKEDAPRQDESAGLG

SEQ ID NO: 7097 - protein, 285 aa, Glycine max
  misc_feature (1)..(285): useful for making plants with modified plant phenotypes as described in USSN 12/139,269
  misc_feature (1)..(285): Ceres CLONE ID no. 476857
  misc_feature (1)..(285): Utility: Useful for making lethal plants for genetic confinement systems
MAVVPYTTGSAPLLSPPSTSSVATKLYSGLKLQAASPFGAAKPNVTAEFYGKVHNTLHCRYANHNTSMARIRMMPIGTPKVPYRTPGEGTWQWVDVWNALYRERVIFIGQEIDEEFSNQILATMLYLDSIENSKKLYMYINGPGGDLTPSMAIYDTMQSLQSPVATHCVGYAYSLAAFLLAAGEKGNRSAMPLSRVALTSPAGAARGQADDIQNEANELLRIRDYLFNELAQKTGQPVEKITKDLSRMKRFNAQEALEYGLIDRIVRPPRIKADAPRKEAGTGLG

SEQ ID NO: 7098 - protein, 297 aa, Glycine max
  misc_feature (1)..(297): useful for making plants with modified plant phenotypes as described in USSN 12/139,269
  misc_feature (1)..(297): Public GI no. 55296987
  misc_feature (1)..(297): Utility: Useful for making lethal plants for genetic confinement systems
MALSAAAPANSSCFHPRAAAASAPSSLSVGTKVFVGLKAQTKLGSSESSCPNVTAGFYTAVNRRISLGLSNKRATRARISMMPVGTPRVPYRTPGEGTWQWLDIWNALYRERIIFIGDSIDEEFSNQVLASMLYLDSVDNTKKILLYINGPGGDLTPCMALYDTMLSLKSPIGTHCLGFAFNLAGFILAAGEKGSRTGMPLCRISLQSPAGAARGQADDIENEANELIRIKNYLYSKLSEHTGHPVDKIHEDLSRVKRFDAEGALEYGIIDRIIRPSRIKKEGSTAQKKDLRNLGLG

SEQ ID NO: 7099 - DNA, 1507 bp, Arabidopsis thaliana
  misc_feature (1)..(1507): useful for making plants with modified plant phenotypes as described in USSN 12/139,269
  misc_feature (1)..(1507): Ceres CLONE ID no. 11214
  misc_feature (1)..(1507): Also known as  Ceres CDNA ID no. 23373243
gatctcatcgaagctcctctctcttacatatcatcacttcacatcaaccaaacctacttctgtctctctctctcgctctctatctctcacgctctcacagtagaagaaaaaattagaaaggttgtgagaatggcggctacagcagcttcaagcttgcaaattgctacacgaaggccgagcatgtcttcgcccagcaaagttcttaaagcaggaacctacattgttggtgccaatcctggaaacgcttcatgggataaactttcatgcactcgccaattatcaaaccttggatgtttgagaaacaacactgctgttccaacttgtaaaagaccgttttctttttccacaagggcaatgtctgaatccagtgaaaataaggctccttcagggcttccaattgatttgagagggaaaagagctttcattgctggtatagctgatgataatggctatggttgggccatagcaaaatctcttgctgctgctggagctgaaatattggttgggacttgggttcctgcacttaatatatttgagacaagcttgagacgtggaaaattcgaccagtcacgagtgttgccggatgggtcattgatggagattaagaaggtctatgctttggatgctgtgtttgacaatcctgaagatgtgcctgaagatgtgaaaacgaataagcgatatgcaggatcgtcaaactggaccgtacaggaagctgctgaatgtgtgaaaaaagattttggaagcattgacattcttgtccattcccttgcaaatggtccagaggttagcaaacctcttctggagacatcaaggaaaggctatctcgctgctatctctgcttcgagttactcctttgtttccttgctgaggcattttctgccaattatgaacccaggaggtgcttcaatatctcttacttacattgcatctgaaagaatcattcctgggtatggtggaggtatgagttctgccaaagctgcactagagagtgacacacgggtgcttgcatatgaagctggaaggaaatcaaacattagggtcaacaccatatctgcgggtcctttgggaagccgaccagcaaaagccattgggttcatagacaccatgattgagtattcctacaataatggacctattcagaaaacactgaccgcagatgaagttgggaatgcagcagccttcttggcatctccattggcctctgccataaccggtgcaaccatatatgtggacaatggtttgaatgcaatgggcgttgcactggacagccccgtgttcaaagaccttaacagcaagaattagagtcttgatcgacgactgaactcgagaaattccgtgttttcgtgagcttgcttgtttctttatgagttagtatgtacggcatatgttccccatcggctgtctttttttttctttctttaagagaataaattatggttctaggttgggtcatttagcaactatatatgtagtgatggattattattcctcttatgattgaaaattt

SEQ ID NO: 7100 - protein, 390 aa, Arabidopsis thaliana
  misc_feature (1)..(390): useful for making plants with modified plant phenotypes as described in USSN 12/139,269
  misc_feature (1)..(390): Utility: Useful for making ornamental plants with flowers and leaves fused
  misc_feature (1)..(390): Utility: Useful for making ornamental plants with modified flowers
  misc_feature (1)..(390): Utility: Useful for making ornamental plants with modified leaves
  misc_feature (1)..(390): Utility: Useful for making plants with altered leaf shape eg curled leaves
  misc_feature (1)..(390): Utility: Useful for making plants with increased biomass
  misc_feature (1)..(390): Utility: Useful for making smaller plants
  misc_feature (316)..(316): Xaa is any aa, unknown or other
MAATAASSLQIATRRPSMSSPSKVLKAGTYIVGANPGNASWDKLSCTRQLSNLGCLRNNTAVPTCKRPFSFSTRAMSESSENKAPSGLPIDLRGKRAFIAGIADDNGYGWAIAKSLAAAGAEILVGTWVPALNIFETSLRRGKFDQSRVLPDGSLMEIKKVYALDAVFDNPEDVPEDVKTNKRYAGSSNWTVQEAAECVKKDFGSIDILVHSLANGPEVSKPLLETSRKGYLAAISASSYSFVSLLRHFLPIMNPGGASISLTYIASERIIPGYGGGMSSAKAALESDTRVLAYEAGRKSNIRVNTISAGPLGSRXAKAIGFIDTMIEYSYNNGPIQKTLTADEVGNAAAFLASPLASAITGATIYVDNGLNAMGVALDSPVFKDLNSKN

SEQ ID NO: 7101 - protein, 390 aa, Arabidopsis thaliana
  misc_feature (1)..(390): useful for making plants with modified plant phenotypes as described in USSN 12/139,269
  misc_feature (1)..(390): Public GI no. 21281125
  misc_feature (1)..(390): Utility: Useful for making ornamental plants with flowers and leaves fused
  misc_feature (1)..(390): Utility: Useful for making ornamental plants with modified flowers
  misc_feature (1)..(390): Utility: Useful for making ornamental plants with modified leaves
  misc_feature (1)..(390): Utility: Useful for making plants with altered leaf shape eg curled leaves
  misc_feature (1)..(390): Utility: Useful for making plants with increased biomass
  misc_feature (1)..(390): Utility: Useful for making smaller plants
MAATAASSLQIATRRPSMSSPSKILKAGTYIVGANPGNASWDKLSCTRQLSNLGCLRNHSAVPTCKRPFSFSTRAMSESSENKAPSGLPIDLRGKRAFIAGIADDNGYGWAIAKSLAAAGAEILVGTWVPALNIFETSLRRGKFDQSRVLPDGSLMEIKKVYALDAVFDNPEDVPEDVKTNKRYAGSSNWTVQEAAECVKKDFGSIDILVHSLANGPEVSKPLLETSRKGYLAAISASSYSFVSLLRHFLPIMNPGGASISLTYIASERIIPGYGGGMSSAKAALESDTRVLAYEAGRKSNIRVNTISAGPLGSRAAKAIGFIDTMIEYSYNNGPIQKTLTADEVGNAAAFLASPLASAITGATIYVDNGLNAMGVALDSPVFKDLNSKN

SEQ ID NO: 7102 - protein, 390 aa, Arabidopsis thaliana
  misc_feature (1)..(390): useful for making plants with modified plant phenotypes as described in USSN 12/139,269
  misc_feature (1)..(390): Public GI no. 7141083
  misc_feature (1)..(390): Utility: Useful for making ornamental plants with flowers and leaves fused
  misc_feature (1)..(390): Utility: Useful for making ornamental plants with modified flowers
  misc_feature (1)..(390): Utility: Useful for making ornamental plants with modified leaves
  misc_feature (1)..(390): Utility: Useful for making plants with altered leaf shape eg curled leaves
  misc_feature (1)..(390): Utility: Useful for making plants with increased biomass
  misc_feature (1)..(390): Utility: Useful for making smaller plants
MAATAASSLQIATRRPSMSSPSKILKAGTYIVGANPGNASWDKLSCTRQLSNLGCLRNHSAVPTCKRPFSFSTRAMSESSENKAPSGLPIDLRGKRAFIAGIADDNGYGWAIAKSLAAAGAEILVGTWVPALNIFETSLRRGKFDQSRVLPDGSLMEIKKVYALDAVFDNPEDVPEDVKTNKRYAGSSNWTVQEAAECVKKDFGSIDILVHSLANGPEVSKPLLETSRKGYLAAISASSYSFVSLLRHFLPIMNPGGASISLTYIASERIIPGYGGGMSSAKAALESDTRVLAYEAGRKSNIRVNTISAGPLGSRAAKAIGFIDTMIEYSYNNGPIQKTLTADEVGNAAAFLASPLASAITGATIYVDNGLNAMGRALDSPVFKDLNSKN

SEQ ID NO: 7103 - protein, 389 aa, Arabidopsis thaliana
  misc_feature (1)..(389): useful for making plants with modified plant phenotypes as described in USSN 12/139,269
  misc_feature (1)..(389): Ceres CLONE ID no. 36277
  misc_feature (1)..(389): Utility: Useful for making ornamental plants with flowers and leaves fused
  misc_feature (1)..(389): Utility: Useful for making ornamental plants with modified flowers
  misc_feature (1)..(389): Utility: Useful for making ornamental plants with modified leaves
  misc_feature (1)..(389): Utility: Useful for making plants with altered leaf shape eg curled leaves
  misc_feature (1)..(389): Utility: Useful for making plants with increased biomass
  misc_feature (1)..(389): Utility: Useful for making smaller plants
MAYSSFTLQIATRRPSMSSPSKILKAGTYIVGANPGNASWDKLSCTRQLSNLGCLRNHSAVPTCKRPFSFSTRAMSESSENKAPSGLPIDLRGKRAFIAGIADDNGYGWAIAKSLAAAGAEILVGTWVPALNIFETSLRRGKFDQSRVLPDGSLMEIKKVYALDAVFDNPEDVPEDVKTNKRYAGSSNWTVQEAAECVKKDFGSIDILVHSLANGPEVSKPLLETSRKGYLAAISASSYSFVSLLRHFLPIMNPGGASISLTYIASERIIPGYGGGMSSAKAALESDTRVLAYEAGRKSNIRVNTISAGPLGSRAAKAIGFIDTMIEYSYNNGPIQKTLTADEVGNAAAFLASPLASAITGATIYVDNGLNAMGVALDSPVFKDLNSKN

SEQ ID NO: 7104 - protein, 312 aa, Brassica napus
  misc_feature (1)..(312): useful for making plants with modified plant phenotypes as described in USSN 12/139,269
  misc_feature (1)..(312): Ceres CLONE ID no. 977208
  misc_feature (1)..(312): Utility: Useful for making ornamental plants with flowers and leaves fused
  misc_feature (1)..(312): Utility: Useful for making ornamental plants with modified flowers
  misc_feature (1)..(312): Utility: Useful for making ornamental plants with modified leaves
  misc_feature (1)..(312): Utility: Useful for making plants with altered leaf shape eg curled leaves
  misc_feature (1)..(312): Utility: Useful for making plants with increased biomass
  misc_feature (1)..(312): Utility: Useful for making smaller plants
MSESSENKASSGLPIDLRGKRAFIAGIADDNGYGWAIAKSLAAAGAEILVGTWVPALNIFETSLRRGKFDQSRVLPDGSLMEIKKVYPLDAVFDSPEDVPEDVKANKRYAGSSNWTVQEAAECVRKDFGTIDILVHSLANGPEVSKPLLETSRKGYLAAISASSYSFVSLLRHFLPIMNPGGASISLTYIASERIIPGYGGGMSSAKAALESDTRVLAFEAGRKQKIRVNTISAGPLGSRAAKAIGFIDTMIEYSYNNAPVQKTLTADEVGNAAAFLVSPLASAITGATIYVDNGLNSMGVAIDSPVFKDLK

SEQ ID NO: 7105 - protein, 386 aa, Brassica napus
  misc_feature (1)..(386): useful for making plants with modified plant phenotypes as described in USSN 12/139,269
  misc_feature (1)..(386): Public GI no. 14422257
  misc_feature (1)..(386): Utility: Useful for making ornamental plants with flowers and leaves fused
  misc_feature (1)..(386): Utility: Useful for making ornamental plants with modified flowers
  misc_feature (1)..(386): Utility: Useful for making ornamental plants with modified leaves
  misc_feature (1)..(386): Utility: Useful for making plants with altered leaf shape eg curled leaves
  misc_feature (1)..(386): Utility: Useful for making plants with increased biomass
  misc_feature (1)..(386): Utility: Useful for making smaller plants
MAATAASSLQFATIRPNISSKVVKAGTYIVGANPRNASSWDKLAFTRHLSKLGCLRNNSSLPTSKKSFSFSTKAMSESSENKASSGLPIDLRGKRAFIAGIADDNGYGWAIAKSLAAAGAEILVGTWVPALNIFETSLRRGKFDQSRVLPDGSLMEIKKVYPLDAVFDSPEDVPEDVKANKRYAGSSNWTVQEAAECVKKDFGTIDILVHSLANGPEVSKPLLETSRKGYLAAISASSYSFVSLLRHFLPIMNPGGASISLTYIASERIIPGYGGGMSSAKAALESDTRVLAFEAGRKQNIRVNTISAGPLGSRAAKAIGFIDTMIEYSYNNAPVQKTLTADEVGNAAAFLVSPLASAITGATIYVDNGLNSMGVAIDSPVFKDLK

SEQ ID NO: 7106 - protein, 385 aa, Brassica napus
  misc_feature (1)..(385): useful for making plants with modified plant phenotypes as described in USSN 12/139,269
  misc_feature (1)..(385): Public GI no. 14422255
  misc_feature (1)..(385): Utility: Useful for making ornamental plants with flowers and leaves fused
  misc_feature (1)..(385): Utility: Useful for making ornamental plants with modified flowers
  misc_feature (1)..(385): Utility: Useful for making ornamental plants with modified leaves
  misc_feature (1)..(385): Utility: Useful for making plants with altered leaf shape eg curled leaves
  misc_feature (1)..(385): Utility: Useful for making plants with increased biomass
  misc_feature (1)..(385): Utility: Useful for making smaller plants
MAATAASSLQFATIRPSISSKVVKAGTYIVGANPRNASWDKLACTRHLSKHGCLRNNSSLPTSKKSFSFSTKAMSESSENKASSGLPIDLRGKRAFIAGIADDNGYGWAIAKSLAAAGAEILVGTWVPALNIFETSLRRGKFDQSRVLPDGSLMEIKKVYPLDAVFDSPEDVPEDVKANKRYAGSSNWTVQEAAECVRKDFGTIDILVHSLANGPEVSKPLLETSRKGYLAAISASSYSFVSLLRHFLPIMNPGGASISLTYIASERIIPGYGGGMSSAKAALESDTRVLAFEAGRKQKIRVNTISAGPLGSRAAKAIGFIDTMIEYSYNNAPVQKTLTADEVGNAAAFLVSPLASAITGATIYVDNGLNSMGVAIDSPVFKDLK

SEQ ID NO: 7107 - protein, 374 aa, Brassica napus
  misc_feature (1)..(374): useful for making plants with modified plant phenotypes as described in USSN 12/139,269
  misc_feature (1)..(374): Ceres CLONE ID no. 1294554
  misc_feature (1)..(374): Utility: Useful for making ornamental plants with flowers and leaves fused
  misc_feature (1)..(374): Utility: Useful for making ornamental plants with modified flowers
  misc_feature (1)..(374): Utility: Useful for making ornamental plants with modified leaves
  misc_feature (1)..(374): Utility: Useful for making plants with altered leaf shape eg curled leaves
  misc_feature (1)..(374): Utility: Useful for making plants with increased biomass
  misc_feature (1)..(374): Utility: Useful for making smaller plants
MATTRPSISAASSKARTYVVGANPRNAYKIACTPHLSNLGCLRNDSALPASKKSFSFSTKAMSESSESKASSGLPIDLRGKRAFIAGIADDNGYGWAVAKSLAAAGAEILVGTWVPALNIFETSLRRGKFDQSRVLPDGSLMEIKKVYPLDAVFDNPEDVPEDVKANKRYAGSSNWTVQEAAECVRQDFGSIDILVHSLANGPEVSKPLLETSRKGYLAAISASSYSFVSLLSHFLPIMNPGGASISLTYIASERIIPGYGGGMSSAKAALESDTRVLAFEAGRKQNIRVNTISAGPLGSRAAKAIGFIDTMIEYSYNNAPIQKTLTADEVGNAAAFLVSPLASAITGATIYVDNGLNSMGVALDSPVFKDLNK

SEQ ID NO: 7108 - protein, 376 aa, Brassica napus
  misc_feature (1)..(376): useful for making plants with modified plant phenotypes as described in USSN 12/139,269
  misc_feature (1)..(376): Ceres CLONE ID no. 1117994
  misc_feature (1)..(376): Utility: Useful for making ornamental plants with flowers and leaves fused
  misc_feature (1)..(376): Utility: Useful for making ornamental plants with modified flowers
  misc_feature (1)..(376): Utility: Useful for making ornamental plants with modified leaves
  misc_feature (1)..(376): Utility: Useful for making plants with altered leaf shape eg curled leaves
  misc_feature (1)..(376): Utility: Useful for making plants with increased biomass
  misc_feature (1)..(376): Utility: Useful for making smaller plants
MATTRASISAASSKARTCIVGANPRNASWDKIACTPHLSNLGCLRNDSALPASKKSFSFSTKAMSEFSESKASSGLPIDLRGKRAFIAGIADDNGYGWAIAKSLAAAGAEILVGTWVPALNIFETSLRRGKFDQSRVLPDGSLMEIKKVYPLDAVFDTPDDVPEDVKANKRYAGSSNWTVQEAAECVRQDFGSIDILVHSLANGPEVSKPLLETTRKGYLAAISASSYSFVSLLSHFLPIMNPGGASISLTYIASERIIPGYGGGMSSAKAALESDTRVLAFEAGRKQNIRVNTISAGPLGSRAAKAIGFIDTMIEYSYNNAPIQKTLTADEVGNAAAFLVSPLASAITGATIYVDNGLNSMGVALDSPVFKDLNK

SEQ ID NO: 7109 - protein, 366 aa, Triticum aestivum
  misc_feature (1)..(366): useful for making plants with modified plant phenotypes as described in USSN 12/139,269
  misc_feature (1)..(366): Ceres CLONE ID no. 697140
  misc_feature (1)..(366): Utility: Useful for making ornamental plants with flowers and leaves fused
  misc_feature (1)..(366): Utility: Useful for making ornamental plants with modified flowers
  misc_feature (1)..(366): Utility: Useful for making ornamental plants with modified leaves
  misc_feature (1)..(366): Utility: Useful for making plants with altered leaf shape eg curled leaves
  misc_feature (1)..(366): Utility: Useful for making plants with increased biomass
  misc_feature (1)..(366): Utility: Useful for making smaller plants
MLAARPCVSASQSMLTSRPAVSRIDLTLVAGSFANCPRISCSRSLGSSRSGAVAVRAVSGEGSSSGLPIDLRGKRAFIAGVADDNGYGWAIAKALAAAGAEILVGTWVPALNIFETSLRRGKFDESRKLPDGSLMEIVKVYPLDAVYDSPEDVPEDVKTNKRYAGSSNWTVKEAAELVKKEYGSIDILVHSLANGPEVTKPLLETSRSGYLAAISASSYSFVSLLKHFLPIMNPGGASISLTYIASERTIPGYGGGMSSAKAALESDTKVLAFEAGRKGKIRVNTISAGPLGSRAAKAIGFIEKMIEYSYVNAPLQKELLADEVGNTAAFLVSPLASAITGSTVYVDNGLNTMGLAVDSPTVSSLL

SEQ ID NO: 7110 - protein, 361 aa, Zea mays
  misc_feature (1)..(361): useful for making plants with modified plant phenotypes as described in USSN 12/139,269
  misc_feature (1)..(361): Ceres CLONE ID no. 264627
  misc_feature (1)..(361): Utility: Useful for making ornamental plants with flowers and leaves fused
  misc_feature (1)..(361): Utility: Useful for making ornamental plants with modified flowers
  misc_feature (1)..(361): Utility: Useful for making ornamental plants with modified leaves
  misc_feature (1)..(361): Utility: Useful for making plants with altered leaf shape eg curled leaves
  misc_feature (1)..(361): Utility: Useful for making plants with increased biomass
  misc_feature (1)..(361): Utility: Useful for making smaller plants
MVAARPCISASPGILTARVAVSRTDCMLSTTATFPKISCSWPLRFKRNDVVVRAISEECGPQGLPIDLRGKRAFIAGVADDNGYGWAIAKALAAAGAEILVGTWVPALNIFETSLRRGKFDESRKLPDGSLMDIVKVYPLDAVYDSPDDVPEDVKSNKRYAGASNWTVKEVVESVRNDFGSIDILVHSLANGPEVTKPLLETSRRGYLAAISASSYSYVSLLQHFLPIMNPGGASISLTYIASERAIPGYGGGMSSAKAALESDTRVLAFEAGRKGKIRVNTISAGPLGSRAAKAIGFIEKMIEYSYVNAPLQKELLADEVGNTAAFLVSSLASAITGSTVYVDNGLNTMGLAIDSPTITS

SEQ ID NO: 7111 - protein, 361 aa, Zea mays; identical to SEQ ID NO: 7110
  misc_feature (1)..(361): useful for making plants with modified plant phenotypes as described in USSN 12/139,269
  misc_feature (1)..(361): Ceres CLONE ID no. 272165
  misc_feature (1)..(361): Utility: Useful for making ornamental plants with flowers and leaves fused
  misc_feature (1)..(361): Utility: Useful for making ornamental plants with modified flowers
  misc_feature (1)..(361): Utility: Useful for making ornamental plants with modified leaves
  misc_feature (1)..(361): Utility: Useful for making plants with altered leaf shape eg curled leaves
  misc_feature (1)..(361): Utility: Useful for making plants with increased biomass
  misc_feature (1)..(361): Utility: Useful for making smaller plants

SEQ ID NO: 7112 - protein, 366 aa, Zea mays
  misc_feature (1)..(366): useful for making plants with modified plant phenotypes as described in USSN 12/139,269
  misc_feature (1)..(366): Ceres CLONE ID no. 338740
  misc_feature (1)..(366): Utility: Useful for making ornamental plants with flowers and leaves fused
  misc_feature (1)..(366): Utility: Useful for making ornamental plants with modified flowers
  misc_feature (1)..(366): Utility: Useful for making ornamental plants with modified leaves
  misc_feature (1)..(366): Utility: Useful for making plants with altered leaf shape eg curled leaves
  misc_feature (1)..(366): Utility: Useful for making plants with increased biomass
  misc_feature (1)..(366): Utility: Useful for making smaller plants
MQMIATRPSIPAYRQILGSTSALSAFGRSICSRTGFAISSKATSAGPLVSSNCKRVVVRAMSQRGAQGLPIDLTGKRAFIAGVADDNGYGWAIAKALAAAGAEILVGTWVPALNIFETSLRRGKFDESRKLPDGSLMEIAKVYPLDAVYDTPEDVPEDVKANKRYAGASNWTVKEVVETVKNDFGSIDILVHSLANGPEVTKSLLETSRRGYLAAISASSYSYVSLLQHFLPIMNPGGASISLTYIASERIIPGYGGGMSSAKAALESDTRVLAYEAGRKGKIRVNTISAGPLGSRAAKAIGFIEKMIEYSYVNAPLQKELLADEVGNTAAFLVSPLASAITGSTIYVDNGLNTMGLALDSPTLST

SEQ ID NO: 7113 - protein, 392 aa, Glycine max
  misc_feature (1)..(392): useful for making plants with modified plant phenotypes as described in USSN 12/139,269
  misc_feature (1)..(392): Ceres CLONE ID no. 472119
  misc_feature (1)..(392): Utility: Useful for making ornamental plants with flowers and leaves fused
  misc_feature (1)..(392): Utility: Useful for making ornamental plants with modified flowers
  misc_feature (1)..(392): Utility: Useful for making ornamental plants with modified leaves
  misc_feature (1)..(392): Utility: Useful for making plants with altered leaf shape eg curled leaves
  misc_feature (1)..(392): Utility: Useful for making plants with increased biomass
  misc_feature (1)..(392): Utility: Useful for making smaller plants
  misc_feature (302)..(302): Xaa is any aa, unknown or other
MAATSFSGMQFAMSRSCIPASQKIADAGAVVLGGKSKIGSWNKLASACHIASVQPFRRGFTSSSIKSVKSDTKALFEFSAQSADSGLSIDLKGKRAFIAGVADDNGYGWAIAKALAAAGAEILVGTWVPALNIFESSLRRGKFDISRILPDGSMMEITKVYPLDAVFDNPDDVPEDIKTNKRYAGSSKWTVQEVAESVKEDFGSIDILVHSLANGPEVTKPLLETSRNGYLAAISASSYSYVSLLKHFLPILNPGGSSISLTYIASERIIPGYGGGMSSAKAALESDTRVLAFEAGRKRKIXVNTISAGPPRSRAAKAIGFIDMMIDYSSANAPLQKEVLAEEVGYTAAFLASPLASAITGTVLYVDNGLNAMGVGVDSPIFKDLNIPKDQH

SEQ ID NO: 7114 - DNA, 589 bp, Glycine max
  misc_feature (1)..(589): useful for making plants with modified plant phenotypes as described in USSN 12/139,269
  misc_feature (1)..(589): Ceres CLONE ID no. 563522
  misc_feature (1)..(589): Also known as  Ceres CDNA ID no. 23692537
aagagtcacactcacaccactttgttttaggttaatattgtgaaagagagatcatgagcaaaagagtaaggagtccaaggttggagcttaggctgaacttgtccccaccaagggcagcagcaacctcaattatatcttcttcggagctgtcgcccacagagtcatcgatgtcgtcgccggtgtcggttcaatcgttggagagctcgtgtgtatcctccgaggctgaagagacaagggcaatgcttctcgtgggctgtcctcggtgcctcatgtatgttatgttgtcggaggttgatcccaaatgccccaagtgcaagagtactgtgttgcttgacttcctcaacaacgaggaaaacaacaataccaagaagagtagcagcgagtgatgatgagacatgtgaagaacagtagctacatgcatcaccgagaaaaagtttgttttctgttattgttggatttccgttttttggttaattagagcagagattggctttttcctatctctgaagttttaattttctgtgaaatttggctgtttcttactgtacgtgtacaagacaaattaagggaagagaatttaaattagttt

SEQ ID NO: 7115 - protein, 110 aa, Glycine max
  misc_feature (1)..(110): useful for making plants with modified plant phenotypes as described in USSN 12/139,269
  misc_feature (1)..(110): Utility: Useful for making ornamental plants with modified color
  misc_feature (1)..(110): Utility: Useful for making ornamental plants with modified leaves
  misc_feature (1)..(110): Utility: Useful for making plants sterile and for genetic confinement
  misc_feature (1)..(110): Utility: Useful for making plants with increased biomass and foliage
  misc_feature (1)..(110): Utility: Useful for making stronger plants
MSKRVRSPRLELRLNLSPPRAAATSIISSSELSPTESSMSSPVSVQSLESSCVSSEAEETRAMLLVGCPRCLMYVMLSEVDPKCPKCKSTVLLDFLNNEENNNTKKSSSE

SEQ ID NO: 7116 - protein, 67 aa, Brassica napus
  misc_feature (1)..(67): useful for making plants with modified plant phenotypes as described in USSN 12/139,269
  misc_feature (1)..(67): Ceres CLONE ID no. 1116523
  misc_feature (1)..(67): Utility: Useful for making ornamental plants with modified color
  misc_feature (1)..(67): Utility: Useful for making ornamental plants with modified leaves
  misc_feature (1)..(67): Utility: Useful for making plants sterile and for genetic confinement
  misc_feature (1)..(67): Utility: Useful for making plants with increased biomass and foliage
  misc_feature (1)..(67): Utility: Useful for making stronger plants
  misc_feature (63)..(63): Xaa is any aa, unknown or other
MSLVRSPSRSNTTSPSSCVSSETYQEEMETTISMVLVGCPRCLMYVMLSQDDPKCPKCKSTVXLDFL

SEQ ID NO: 7117 - protein, 119 aa, Brassica napus
  misc_feature (1)..(119): useful for making plants with modified plant phenotypes as described in USSN 12/139,269
  misc_feature (1)..(119): Ceres CLONE ID no. 973582
  misc_feature (1)..(119): Utility: Useful for making ornamental plants with modified color
  misc_feature (1)..(119): Utility: Useful for making ornamental plants with modified leaves
  misc_feature (1)..(119): Utility: Useful for making plants sterile and for genetic confinement
  misc_feature (1)..(119): Utility: Useful for making plants with increased biomass and foliage
  misc_feature (1)..(119): Utility: Useful for making stronger plants
MSLRNKNGPKLELKLNLSPPPSQANLMSLVRSPSRSNTTSPSSCVSSETYQEEMETTISMLLVGCPRCLMYVMLSQDDPKCPKCKSTVLLDFLHQDVSAATTAPADITKRNKTWWNFFV

SEQ ID NO: 7118 - protein, 99 aa, Arabidopsis thaliana
  misc_feature (1)..(99): useful for making plants with modified plant phenotypes as described in USSN 12/139,269
  misc_feature (1)..(99): Ceres CLONE ID no. 104017
  misc_feature (1)..(99): Utility: Useful for making ornamental plants with modified color
  misc_feature (1)..(99): Utility: Useful for making ornamental plants with modified leaves
  misc_feature (1)..(99): Utility: Useful for making plants sterile and for genetic confinement
  misc_feature (1)..(99): Utility: Useful for making plants with increased biomass and foliage
  misc_feature (1)..(99): Utility: Useful for making stronger plants
MVRSPSRSATTSPTSPPSSCVSSEMNQDEPSVRYSTSPETTSMVLVGCPRCLMYVMLSEDDPKCPKCKSTVLLDFLHENATNANANAAAASSGRKTRRN

SEQ ID NO: 7119 - protein, 122 aa, Arabidopsis thaliana
  misc_feature (1)..(122): useful for making plants with modified plant phenotypes as described in USSN 12/139,269
  misc_feature (1)..(122): Public GI no. 21536580
  misc_feature (1)..(122): Utility: Useful for making ornamental plants with modified color
  misc_feature (1)..(122): Utility: Useful for making ornamental plants with modified leaves
  misc_feature (1)..(122): Utility: Useful for making plants sterile and for genetic confinement
  misc_feature (1)..(122): Utility: Useful for making plants with increased biomass and foliage
  misc_feature (1)..(122): Utility: Useful for making stronger plants
MSRRSPKLELKLNLSPPTSSQRRMVRSPSRSATTSPTSPPSSCVSSEMNQDEPSVRYSTSPETTSMVLVGCPRCLMYVMLSEDDPKCPKCKSTVLLDFLHENATNANANAAAASSGRKTRRN

SEQ ID NO: 7120 - protein, 118 aa, Brassica napus
  misc_feature (1)..(118): useful for making plants with modified plant phenotypes as described in USSN 12/139,269
  misc_feature (1)..(118): Ceres CLONE ID no. 946814
  misc_feature (1)..(118): Utility: Useful for making ornamental plants with modified color
  misc_feature (1)..(118): Utility: Useful for making ornamental plants with modified leaves
  misc_feature (1)..(118): Utility: Useful for making plants sterile and for genetic confinement
  misc_feature (1)..(118): Utility: Useful for making plants with increased biomass and foliage
  misc_feature (1)..(118): Utility: Useful for making stronger plants
MSRRNRSGPKLELKLNLSPPPSQGEQMSMVRSPSRSNTASPNSCVSSEPSQEEMETPISMVLVGCPRCLMYVMLSQDEPKCPKCKSTVLLDFFHENASVDTTAPAVTTKRNKSLITNI

SEQ ID NO: 7121 - protein, 93 aa, Arabidopsis thaliana
  misc_feature (1)..(93): useful for making plants with modified plant phenotypes as described in USSN 12/139,269
  misc_feature (1)..(93): Ceres CLONE ID no. 35419
  misc_feature (1)..(93): Utility: Useful for making ornamental plants with modified color
  misc_feature (1)..(93): Utility: Useful for making ornamental plants with modified leaves
  misc_feature (1)..(93): Utility: Useful for making plants sterile and for genetic confinement
  misc_feature (1)..(93): Utility: Useful for making plants with increased biomass and foliage
  misc_feature (1)..(93): Utility: Useful for making stronger plants
MNQEAASNLGLDLKLNISPSLDSSLLTESSSSSLCSEEAEGGGGEAKSMVVVGCPNCIMYIITSLENDPRCPRCNSHVLLDFLTGNHSKKSTS

SEQ ID NO: 7122 - protein, 93 aa, Arabidopsis thaliana; identical to SEQ ID NO: 7121
  misc_feature (1)..(93): useful for making plants with modified plant phenotypes as described in USSN 12/139,269
  misc_feature (1)..(93): Public GI no. 20466099
  misc_feature (1)..(93): Utility: Useful for making ornamental plants with modified color
  misc_feature (1)..(93): Utility: Useful for making ornamental plants with modified leaves
  misc_feature (1)..(93): Utility: Useful for making plants sterile and for genetic confinement
  misc_feature (1)..(93): Utility: Useful for making plants with increased biomass and foliage
  misc_feature (1)..(93): Utility: Useful for making stronger plants

SEQ ID NO: 7123 - protein, 93 aa, Arabidopsis thaliana
  misc_feature (1)..(93): useful for making plants with modified plant phenotypes as described in USSN 12/139,269
  misc_feature (1)..(93): Public GI no. 21593032
  misc_feature (1)..(93): Utility: Useful for making ornamental plants with modified color
  misc_feature (1)..(93): Utility: Useful for making ornamental plants with modified leaves
  misc_feature (1)..(93): Utility: Useful for making plants sterile and for genetic confinement
  misc_feature (1)..(93): Utility: Useful for making plants with increased biomass and foliage
  misc_feature (1)..(93): Utility: Useful for making stronger plants
MNQEAASNLGLDLKLNISPSLDSSLLTESSLSSLCSEEAEGGGGEAKSMVVVGCPNCIMYIITSLENDPRCPRCNSHVLLDFLTGNHSKKSTS

SEQ ID NO: 7124 - protein, 85 aa, Zea mays
  misc_feature (1)..(85): useful for making plants with modified plant phenotypes as described in USSN 12/139,269
  misc_feature (1)..(85): Ceres CLONE ID no. 1276697
  misc_feature (1)..(85): Utility: Useful for making ornamental plants with modified color
  misc_feature (1)..(85): Utility: Useful for making ornamental plants with modified leaves
  misc_feature (1)..(85): Utility: Useful for making plants sterile and for genetic confinement
  misc_feature (1)..(85): Utility: Useful for making plants with increased biomass and foliage
  misc_feature (1)..(85): Utility: Useful for making stronger plants
MADEESSPSSCLSSENEHGLQWSNSPEATSMVLAACPRCFIYVMLPQDDPRCPQCKSPVLLDFLQDNNNNSKNNSNNSSRRSRRG

SEQ ID NO: 7125 - protein, 115 aa, Zea mays
  misc_feature (1)..(115): useful for making plants with modified plant phenotypes as described in USSN 12/139,269
  misc_feature (1)..(115): Ceres CLONE ID no. 988038
  misc_feature (1)..(115): Utility: Useful for making ornamental plants with modified color
  misc_feature (1)..(115): Utility: Useful for making ornamental plants with modified leaves
  misc_feature (1)..(115): Utility: Useful for making plants sterile and for genetic confinement
  misc_feature (1)..(115): Utility: Useful for making plants with increased biomass and foliage
  misc_feature (1)..(115): Utility: Useful for making stronger plants
MSRSNRKSSRGLDLKLNLSLPATGDSSRRAMADEESSPSSCLSSENEHGLQWSNSPEATSMVLAACPRCFIYVMLPQDDPRCPQCKSPVLLDFLQDNNNNSKNNSNNSSRRSRRG

SEQ ID NO: 7126 - protein, 84 aa, Triticum aestivum
  misc_feature (1)..(84): useful for making plants with modified plant phenotypes as described in USSN 12/139,269
  misc_feature (1)..(84): Ceres CLONE ID no. 631994
  misc_feature (1)..(84): Utility: Useful for making ornamental plants with modified color
  misc_feature (1)..(84): Utility: Useful for making ornamental plants with modified leaves
  misc_feature (1)..(84): Utility: Useful for making plants sterile and for genetic confinement
  misc_feature (1)..(84): Utility: Useful for making plants with increased biomass and foliage
  misc_feature (1)..(84): Utility: Useful for making stronger plants
MADEESSPSSCLSSENEHGLQWSNSPEATSMVLAACPRCFIYVMLPQDDPRCPQCKSPVLLDFLQDSGNNNNNTNSNSRKSRRG

SEQ ID NO: 7127 - protein, 83 aa, Zea mays
  misc_feature (1)..(83): useful for making plants with modified plant phenotypes as described in USSN 12/139,269
  misc_feature (1)..(83): Ceres CLONE ID no. 457248
  misc_feature (1)..(83): Utility: Useful for making ornamental plants with modified color
  misc_feature (1)..(83): Utility: Useful for making ornamental plants with modified leaves
  misc_feature (1)..(83): Utility: Useful for making plants sterile and for genetic confinement
  misc_feature (1)..(83): Utility: Useful for making plants with increased biomass and foliage
  misc_feature (1)..(83): Utility: Useful for making stronger plants
MVMADEESSPSSCLSSENEHGLQWSNSPEATSMVLAACPRCFIYVMLPQDDPWCPQCKSPVLLDFLQDNSNNSNNSSRRSRKG

SEQ ID NO: 7128 - protein, 111 aa, Zea mays
  misc_feature (1)..(111): useful for making plants with modified plant phenotypes as described in USSN 12/139,269
  misc_feature (1)..(111): Ceres CLONE ID no. 370255
  misc_feature (1)..(111): Utility: Useful for making ornamental plants with modified color
  misc_feature (1)..(111): Utility: Useful for making ornamental plants with modified leaves
  misc_feature (1)..(111): Utility: Useful for making plants sterile and for genetic confinement
  misc_feature (1)..(111): Utility: Useful for making plants with increased biomass and foliage
  misc_feature (1)..(111): Utility: Useful for making stronger plants
MSRSNKKSSRGLDLKLNLSLPATGDSSGMVMADEESSPSSCLSSENEHGLQWSNSPEATSMVLAACPRCFIYVMLPQDDPWCPQCKSPVLLDFLQDNSNNSNNSSRRSRKG

SEQ ID NO: 7129 - protein, 68 aa, Triticum aestivum
  misc_feature (1)..(68): useful for making plants with modified plant phenotypes as described in USSN 12/139,269
  misc_feature (1)..(68): Ceres CLONE ID no. 938645
  misc_feature (1)..(68): Utility: Useful for making ornamental plants with modified color
  misc_feature (1)..(68): Utility: Useful for making ornamental plants with modified leaves
  misc_feature (1)..(68): Utility: Useful for making plants sterile and for genetic confinement
  misc_feature (1)..(68): Utility: Useful for making plants with increased biomass and foliage
  misc_feature (1)..(68): Utility: Useful for making stronger plants
MEVDGHNDSGSSSPSSCVSSDGSPGSKSPMVIGACTRCLMYCMVAKKDYPTCINCKQPCLVDLLQNGG

SEQ ID NO: 7130 - protein, 85 aa, Triticum aestivum
  misc_feature (1)..(85): useful for making plants with modified plant phenotypes as described in USSN 12/139,269
  misc_feature (1)..(85): Ceres CLONE ID no. 685517
  misc_feature (1)..(85): Utility: Useful for making ornamental plants with modified color
  misc_feature (1)..(85): Utility: Useful for making ornamental plants with modified leaves
  misc_feature (1)..(85): Utility: Useful for making plants sterile and for genetic confinement
  misc_feature (1)..(85): Utility: Useful for making plants with increased biomass and foliage
  misc_feature (1)..(85): Utility: Useful for making stronger plants
MEVDGHDDSGSSSPSSCVSSDGSPGSKSPMVIGACTRCLMYCMVAKKDYPTCINCKQPCLVDLLQNGGAGAGASGDGDKKRGKRK

SEQ ID NO: 7131 - protein, 83 aa, Zea mays
  misc_feature (1)..(83): useful for making plants with modified plant phenotypes as described in USSN 12/139,269
  misc_feature (1)..(83): Ceres CLONE ID no. 395326
  misc_feature (1)..(83): Utility: Useful for making ornamental plants with modified color
  misc_feature (1)..(83): Utility: Useful for making ornamental plants with modified leaves
  misc_feature (1)..(83): Utility: Useful for making plants sterile and for genetic confinement
  misc_feature (1)..(83): Utility: Useful for making plants with increased biomass and foliage
  misc_feature (1)..(83): Utility: Useful for making stronger plants
MVMADEESSPSSCLSSENEHGLQWSNSPEATSMVLAACPRCFIYVMLPQDDPWCPQCNSPVLLDFLQDNSNNSNNSSRRSRKG

SEQ ID NO: 7132 - protein, 116 aa, Zea mays
  misc_feature (1)..(116): useful for making plants with modified plant phenotypes as described in USSN 12/139,269
  misc_feature (1)..(116): Public GI no. 50924115
  misc_feature (1)..(116): Utility: Useful for making ornamental plants with modified color
  misc_feature (1)..(116): Utility: Useful for making ornamental plants with modified leaves
  misc_feature (1)..(116): Utility: Useful for making plants sterile and for genetic confinement
  misc_feature (1)..(116): Utility: Useful for making plants with increased biomass and foliage
  misc_feature (1)..(116): Utility: Useful for making stronger plants
MSRSNKKSSRGIDLKLNLSLPARGDSSSRRAMAADEESSPSSCLSSENEHGLQWSNSPEATSMVLAACPRCFIYVMLPQDDPRCPQCKSPVILDFLQQDNGNNNANSNSSRKTRRG

SEQ ID NO: 7133 - DNA, 820 bp, Arabidopsis thaliana
  misc_feature (1)..(820): useful for making plants with modified plant phenotypes as described in USSN 12/139,269
  misc_feature (1)..(820): Ceres CLONE ID no. 21563
  misc_feature (1)..(820): Also known as  Ceres CDNA ID no. 23462620
aatcaaatcaaatctgtgtttcattctcttctccactgaaacgcgtttgaaggagaagggtcaaagggatctgatcctatcactttcgctgggaaaaacacgaaatcgaaggaagaatcaatcatgggtttcatcggataaactgtagattccatcaaatctatcaagatccgtcaagttctcactcaggctatcactctcggtatgatcgttacatctgcattgataatttggaaggcattgatatgtgtcactggcagtgaatcaccagtggttgttgttctctctgaaagtatggaacctggctttcagagaggagatatattgttcttgcggatgactgatgagcctattcgagcaggcgagattgttgtgttcagtgttgatggtcgtgaaattcccattgttcatcgagcaatcaaagttcatgagagaggagatactaaagcagttgatgttctaacaaaaggtgacaacaatgacattgatgacattggtctctatgctgaaggacagctttggcttcacaggcatcatatcatgggcagagctgttggattcttgccttatgttggatgggttactattatcatgacagaaaagcctatcatcaagtatatactcattggtgcattgggtttgctcgttataacatcgaaagactaagactacataacaagctggtcgttggtaaggaggtagcttctgcaacgctcgggtcatcatctttgtagccatcatctttgaaactgtagaatcatataaacctcaacttataattatagacacttttatctttaaatcagctacgttttgtggc

SEQ ID NO: 7134 - protein, 153 aa, Arabidopsis thaliana
  misc_feature (1)..(153): useful for making plants with modified plant phenotypes as described in USSN 12/139,269
  misc_feature (25)..(97): Pfam Name: Peptidase_S24; Pfam Description: Peptidase S24-like
  misc_feature (1)..(153): Utility: Useful for making ornamental plants with modified flowers
  misc_feature (1)..(153): Utility: Useful for making plants with increased biomass and foliage
  misc_feature (1)..(153): Utility: Useful for making smaller plants
MIVTSALIIWKALICVTGSESPVVVVLSESMEPGFQRGDILFLRMTDEPIRAGEIVVFSVDGREIPIVHRAIKVHERGDTKAVDVLTKGDNNDIDDIGLYAEGQLWLHRHHIMGRAVGFLPYVGWVTIIMTEKPIIKYILIGALGLLVITSKD

SEQ ID NO: 7135 - protein, 153 aa, Arabidopsis thaliana
  misc_feature (1)..(153): useful for making plants with modified plant phenotypes as described in USSN 12/139,269
  misc_feature (1)..(153): Ceres CLONE ID no. 103157
  misc_feature (1)..(153): Utility: Useful for making ornamental plants with modified flowers
  misc_feature (1)..(153): Utility: Useful for making plants with increased biomass and foliage
  misc_feature (1)..(153): Utility: Useful for making smaller plants
MIVTSALIIWKALMCVTGSESPVVVVLSGSMEPGFKRGDILFLHMSKDPIRAGEIVVFNVDGRDIPIVHRVIKVHERENTGEVDVLTKGDNNYGDDRLLYAEGQLWLHRHHIMGRAVGFLPYVGWVTIIMTEKPIIKYILIGALGLLVITSKD

SEQ ID NO: 7136 - protein, 180 aa, Glycine max
  misc_feature (1)..(180): useful for making plants with modified plant phenotypes as described in USSN 12/139,269
  misc_feature (1)..(180): Ceres CLONE ID no. 528914
  misc_feature (1)..(180): Utility: Useful for making ornamental plants with modified flowers
  misc_feature (1)..(180): Utility: Useful for making plants with increased biomass and foliage
  misc_feature (1)..(180): Utility: Useful for making smaller plants
MGWIGETVDSIKSLQIRQVLTQAVSLGMIVTSALIIWKALMCVTGSESPVVVVLSGSMEPGFKRGDILFLHMSKDPIRAGEIVVFNVDGREIPIVHRVIKVHEREDTGEVDVLTKGDNNYGDDRLLYAHGQLWLQRHHIMGRAVGFLPYVGWVTIIMTEKPIIKYILIGALGLLVITSKD

SEQ ID NO: 7137 - protein, 180 aa, Glycine max
  misc_feature (1)..(180): useful for making plants with modified plant phenotypes as described in USSN 12/139,269
  misc_feature (1)..(180): Public GI no. 20465737
  misc_feature (1)..(180): Utility: Useful for making ornamental plants with modified flowers
  misc_feature (1)..(180): Utility: Useful for making plants with increased biomass and foliage
  misc_feature (1)..(180): Utility: Useful for making smaller plants
MGWIGETVDSIKSIQIRQLFTQAISLGMIVTSALIIWKALMCVTGSESPVVVVLSGSMEPGFKRGDILFLHMSKDPIRAGEIVVFNVDGRDIPIVHRVIKVHERENTGEVDVLTKGDNNYGDDRLLYAEGQLWLHRHHIMGRAVGFLPYVGWVTIIMTEKPIIKYILIGALGLLVITSKD

SEQ ID NO: 7138 - protein, 180 aa, Glycine max
  misc_feature (1)..(180): useful for making plants with modified plant phenotypes as described in USSN 12/139,269
  misc_feature (1)..(180): Public GI no. 62318522
  misc_feature (1)..(180): Utility: Useful for making ornamental plants with modified flowers
  misc_feature (1)..(180): Utility: Useful for making plants with increased biomass and foliage
  misc_feature (1)..(180): Utility: Useful for making smaller plants
MGWIGETVDSIKSIQIRQLFTQAISLGMIVTSALIIWKALMCVTGSESPVVVVLSGSMEPGFKRGDILFLHMSKDPVRAGEIVVFNVDGRDIPIVHRVIKVHERENTGEVDVLTKGDNNYGDDRLLYAEGQLWLHRHHIMGRAVGFLPYVGWVTIIMTEKPIIKYILIGALGLLVITSKD

SEQ ID NO: 7139 - protein, 180 aa, Glycine max
  misc_feature (1)..(180): useful for making plants with modified plant phenotypes as described in USSN 12/139,269
  misc_feature (1)..(180): Public GI no. 55296017
  misc_feature (1)..(180): Utility: Useful for making ornamental plants with modified flowers
  misc_feature (1)..(180): Utility: Useful for making plants with increased biomass and foliage
  misc_feature (1)..(180): Utility: Useful for making smaller plants
MGFIGDTIESIRSMQVRQVLAQIISLGMIVTSALIIWKGLIVVTGSESPVVVVLSGSMEPGFKRGDILFLHMSKDPIRTGEIVVFNVDGREIPIVHRVIKVHERQESAEVDILTKGDNNFGDDRLLYAHGQLWLQQHHIMGRAVGFLPYVGWVTIIMTEKPIIKYLLIGALGLLVITSKE

SEQ ID NO: 7140 - protein, 162 aa, Zea mays
  misc_feature (1)..(162): useful for making plants with modified plant phenotypes as described in USSN 12/139,269
  misc_feature (1)..(162): Ceres CLONE ID no. 1589040
  misc_feature (1)..(162): Utility: Useful for making ornamental plants with modified flowers
  misc_feature (1)..(162): Utility: Useful for making plants with increased biomass and foliage
  misc_feature (1)..(162): Utility: Useful for making smaller plants
  misc_feature (140)..(140): Xaa is any aa, unknown or other
MQIRPVVAQIITLGMILTSALILWKGFVVVTGSESPVVVVLSGSMEPGFRKGDVLFLHMNKDPVRTGDIVVFNVEGRDIPIVHRVIKVHERHDTVDSDILTKGDNNPGDDRVLYAHGQLWLQRQHIIGRGCGYLPYAGWXTIVMTEKPVPQYLLMVHWGCWW

SEQ ID NO: 7141 - DNA, 914 bp, Arabidopsis thaliana
  misc_feature (1)..(914): useful for making plants with modified plant phenotypes as described in USSN 12/139,269
  misc_feature (1)..(914): Ceres CLONE ID no. 6397
  misc_feature (1)..(914): Also known as  Ceres CDNA ID no. 23373703
acttcattagtctccaagaagaaaacatctctcactctctaaaatacacactctcatcaaaaaccttctcttcggttcagaagcattcaagaatccattatgagctcatctgattccgttaataacggcgttaactcacggatgtacttccgtaacccgagtttcagcaacgttatcttaaacgataactggagcgacttgccgttaagtgtcgacgattctcaagacatggctatttacaacactctccgtgatgccgttagctccgcctggacaccatccgttcctcccgttacctctccggcggaggaagataagcctccggcgacgaaggcgagtggctcacacgcgccgaggcagaaggggatgcagtacagaggagtgaggaggaggccgtgggggaaattcgcggcggagattagggatccgaagaagaacggagctagggtttggctcgggacttacgagacgccggaggacgcggcggtggcgtacgaccgagcggcgtttcagctcagaggatcgaaagctaagctgaattttccgcatttgattggttcttgtaagtatgagccggttaggattaggcctcgccgtcgctcgccggaaccgtcagtctccgatcagttaacgtcggagcagaagagggaaagccacgtggatgacggcaagtctagtttggttgtaccggagttggatttcacggtggatcagttttacttcgatggtagtttattaatggaccaatcagaatgttcttattctgataatcggatataattagttttaagattaagcaaaatttgtccaacgagttttgctgtatgaaatatctatcgatgactcaacaggttttgatcatgatcatatgtaatgtgatggaaattaaatattgacgtttgtttttttcttcc

SEQ ID NO: 7142 - protein, 226 aa, Arabidopsis thaliana
  misc_feature (1)..(226): useful for making plants with modified plant phenotypes as described in USSN 12/139,269
  misc_feature (90)..(154): Pfam Name: AP2; Pfam Description: AP2 domain
  misc_feature (1)..(226): Utility: Useful for making ornamental plants with modified flowers
  misc_feature (1)..(226): Utility: Useful for making plants sterile and for genetic confinement
MSSSDSVNNGVNSRMYFRNPSFSNVILNDNWSDLPLSVDDSQDMAIYNTLRDAVSSAWTPSVPPVTSPAEEDKPPATKASGSHAPRQKGMQYRGVRRRPWGKFAAEIRDPKKNGARVWLGTYETPEDAAVAYDRAAFQLRGSKAKLNFPHLIGSCKYEPVRIRPRRRSPEPSVSDQLTSEQKRESHVDDGKSSLVVPELDFTVDQFYFDGSLLMDQSECSYSDNRI

SEQ ID NO: 7143 - protein, 237 aa, Arabidopsis thaliana
  misc_feature (1)..(237): useful for making plants with modified plant phenotypes as described in USSN 12/139,269
  misc_feature (1)..(237): Public GI no. 57012876
  misc_feature (1)..(237): Utility: Useful for making ornamental plants with modified flowers
  misc_feature (1)..(237): Utility: Useful for making plants sterile and for genetic confinement
MYQPISTEFPVYHRTSSFSSLMPCLTDTWGDLPLKVDDSEDMVIYGLLSDALTTGWTPFNLTSTEIKAEPREEIEPATSPVPSVAPPAETTTAQAVVPKGRHYRGVRQRPWGKFAAEIRDPAKNGARVWLGTYETAEEAALAYDKAAYRMRGSKALLNFPHRIGLNEPEPVRLTVKRRSPEPASSSISPASENSLPKRRRKAVAAKQAELEVQSRSNVMQVGCQMEQFPVGEQLLVS

SEQ ID NO: 7144 - protein, 234 aa, Arabidopsis thaliana
  misc_feature (1)..(234): useful for making plants with modified plant phenotypes as described in USSN 12/139,269
  misc_feature (1)..(234): Public GI no. 3342211
  misc_feature (1)..(234): Utility: Useful for making ornamental plants with modified flowers
  misc_feature (1)..(234): Utility: Useful for making plants sterile and for genetic confinement
MDQQLPPTNFPVDFPVYRRNSSFSRLIPCLTEKWGDLPLKVDDSEDMVIYGLLKDALSVGWSPFNFTAGEVKSEPREEIESSPEFSPSPAETTAAPAAETPKGRHYRGVRQRPWGKFAAEIRDPAKNGARVWLGTYETAEEAAIAYDKAAYRMRGSKAHLNFPHRIGLNEPEPVRVTAKRRASPEPASSSGNGSMKRRRKAVQKCDGEMASRSSVMQVGCQIEQLTGVHQLLVI

SEQ ID NO: 7145 - DNA, 1139 bp, Arabidopsis thaliana
  misc_feature (1)..(1139): useful for making plants with modified plant phenotypes as described in USSN 12/139,269
  misc_feature (1)..(1139): Ceres CLONE ID no. 14555
  misc_feature (1)..(1139): Also known as  Ceres CDNA ID no. 23396049
aattttgaattgagcgaggtttcaaagttcaaaactatcacaactagtcttgatcaattctatataagatctgtgatcttggttgaagaaaagaatcgtcgtaggttgatatttaacaaggaatggcaaaggaagggggcttgggagagaactcaagatggagtcttggaggcatgaccgctcttgtcactggtggctctaaaggcatcggggaagctgtggtggaggaactagccatgttgggagcaaaagtccacacgtgtgccagagacgaaactcagcttcaagaacgcttacgtgaatggcaagcaaaagggtttcaggtcaccacttctgtctgcgacgtctcttctcgtgaccaacgagtgaaactcatggaaactgtttcctctctctaccaaggaaaactcaacatcctcgtcaacaatgtgggaacgtcaatattcaagccgaccacagagtatacagcagaagatttctcttttgtaatggctacaaatctcgagtcagctttccatctctcacagcttgcccacccattgttaaaagcctctggctcagggagcatcgtgctcatatcctctgctgctggagtcgtgcatgtcaatgttggatccatctatggagcaaccaaaggagccatgaatcagctggctagaaacttagcttgcgaatgggcgagcgacaacataaggacgaactctgtttgtccttggtatatcacaactcctttaagtaacgattttttcgatgaagagtttaagaaagaagcggtgcgtacgacaccaatggggcgtgttggagaagcaaatgaagtctcaccgcttgtggcatttctttgtcttccttcagcttcttatattactggtcagaccatttgcgttgacggcggtgccactgttaacggtttttccttcaagactatgccataaaacacatatgcatgtgtttggatcatattttcaataatttaaacttacgggttatatacatcgtcaatatgtaataaatgtaatttagatgtgtccacatgttctgtttctaagagattcttagatatttatgcttgcgtggtgaacaagagttcactctccggatggaccgcatccataatctatgaatttgggaattatattacc

SEQ ID NO: 7146 - protein, 269 aa, Arabidopsis thaliana
  misc_feature (1)..(269): useful for making plants with modified plant phenotypes as described in USSN 12/139,269
  misc_feature (18)..(186): Pfam Name: adh_short; Pfam Description: short chain dehydrogenase
  misc_feature (1)..(269): Utility: Useful for making ornamental plants with modified flowers
  misc_feature (1)..(269): Utility: Useful for making plants with altered leaf shape eg curled leaves
  misc_feature (1)..(269): Utility: Useful for making plants with increased biomass
  misc_feature (1)..(269): Utility: Useful for making plants with increased biomass and foliage
  misc_feature (1)..(269): Utility: Useful for making shorter plants and plants with modified flowers
  misc_feature (1)..(269): Utility: Useful for making smaller plants
  misc_feature (1)..(269): Utility: Useful for modifying plant architecture, ie amount of branching
MAKEGGLGENSRWSLGGMTALVTGGSKGIGEAVVEELAMLGAKVHTCARDETQLQERLREWQAKGFQVTTSVCDVSSRDQRVKLMETVSSLYQGKLNILVNNVGTSIFKPTTEYTAEDFSFVMATNLESAFHLSQLAHPLLKASGSGSIVLISSAAGVVHVNVGSIYGATKGAMNQLARNLACEWASDNIRTNSVCPWYITTPLSNDFFDEEFKKEAVRTTPMGRVGEANEVSPLVAFLCLPSASYITGQTICVDGGATVNGFSFKTMP

SEQ ID NO: 7147 - protein, 253 aa, Arabidopsis thaliana
  misc_feature (1)..(253): useful for making plants with modified plant phenotypes as described in USSN 12/139,269
  misc_feature (1)..(253): Ceres CLONE ID no. 1339647
  misc_feature (1)..(253): Utility: Useful for making ornamental plants with modified flowers
  misc_feature (1)..(253): Utility: Useful for making plants with altered leaf shape eg curled leaves
  misc_feature (1)..(253): Utility: Useful for making plants with increased biomass
  misc_feature (1)..(253): Utility: Useful for making plants with increased biomass and foliage
  misc_feature (1)..(253): Utility: Useful for making shorter plants and plants with modified flowers
  misc_feature (1)..(253): Utility: Useful for making smaller plants
  misc_feature (1)..(253): Utility: Useful for modifying plant architecture, ie amount of branching
MNALVTGGTKGIGEAVVEELSILGARVHTCARDETQLQERLREWQEKGFQVTTSICDVSLREQREKLMETVSSLFQGKLNILVNNVGTLMLKPTTEYTAEEFSFLMATNLDSAFHISQLAHPLLKASGSGSIVLMSSIAGVVHVGVGSIYGATKGAMNQLARNLACEWASDNIRTNAICPWLITTPLISDLLSVEEMKKEAEERTPMGRVGEANEVSPLVAFLCLPAASYITGQVICVDGGLTVNGFSYQPHA

SEQ ID NO: 7148 - protein, 262 aa, Arabidopsis thaliana
  misc_feature (1)..(262): useful for making plants with modified plant phenotypes as described in USSN 12/139,269
  misc_feature (1)..(262): Public GI no. 34146804
  misc_feature (1)..(262): Utility: Useful for making ornamental plants with modified flowers
  misc_feature (1)..(262): Utility: Useful for making plants with altered leaf shape eg curled leaves
  misc_feature (1)..(262): Utility: Useful for making plants with increased biomass
  misc_feature (1)..(262): Utility: Useful for making plants with increased biomass and foliage
  misc_feature (1)..(262): Utility: Useful for making shorter plants and plants with modified flowers
  misc_feature (1)..(262): Utility: Useful for making smaller plants
  misc_feature (1)..(262): Utility: Useful for modifying plant architecture, ie amount of branching
MDKRWSLQGMNALVTGGTKGIGEAVVEELSILGARVHTCARDETQLQERLREWQEKGFQVTTSICDVSLREQREKLMETVSSLFQGKLNILVNNVGTLMLKPTTEYTAEEFSFLMATNLDSAFHISQLAHPLLKASGSGSIVLMSSIAGVVHVGVGSIYGATKGAMNQLARNLACEWASDNIRTNAICPWLITTPLISDLLSVEEMKKEAEERTPMGRVGEANEVSPLVAFLCLPAASYITGQVICVDGGLTVNGFSYQPHA

SEQ ID NO: 7149 - protein, 268 aa, Arabidopsis thaliana
  misc_feature (1)..(268): useful for making plants with modified plant phenotypes as described in USSN 12/139,269
  misc_feature (1)..(268): Public GI no. 3980415
  misc_feature (1)..(268): Utility: Useful for making ornamental plants with modified flowers
  misc_feature (1)..(268): Utility: Useful for making plants with altered leaf shape eg curled leaves
  misc_feature (1)..(268): Utility: Useful for making plants with increased biomass
  misc_feature (1)..(268): Utility: Useful for making plants with increased biomass and foliage
  misc_feature (1)..(268): Utility: Useful for making shorter plants and plants with modified flowers
  misc_feature (1)..(268): Utility: Useful for making smaller plants
  misc_feature (1)..(268): Utility: Useful for modifying plant architecture, ie amount of branching
MAKAEENLRDKCRWSLGGMTALVTGGSKGLGEAVVEELAMLGARVHTCARNETQLQECVREWQAKGFEVTTSVCDVSSRDQREKLMENVASIFQGKLNILVNNAGTGITKPTTEYTAQDYSFLMATNLDSAFHLSQLAHPLLKASGSGSIVLMSSTAGVVHINVGSIYGATKGAMNQLAKNLACEWARDNIRVNSVCPWFIATPLYLNDEELKKEVERKTPMGRVGNANEVSSLVAFLCFPAASYITGQTICVDGGFTVNCFSFKPVL

SEQ ID NO: 7150 - protein, 253 aa, Arabidopsis thaliana
  misc_feature (1)..(253): useful for making plants with modified plant phenotypes as described in USSN 12/139,269
  misc_feature (1)..(253): Ceres CLONE ID no. 2618
  misc_feature (1)..(253): Utility: Useful for making ornamental plants with modified flowers
  misc_feature (1)..(253): Utility: Useful for making plants with altered leaf shape eg curled leaves
  misc_feature (1)..(253): Utility: Useful for making plants with increased biomass
  misc_feature (1)..(253): Utility: Useful for making plants with increased biomass and foliage
  misc_feature (1)..(253): Utility: Useful for making shorter plants and plants with modified flowers
  misc_feature (1)..(253): Utility: Useful for making smaller plants
  misc_feature (1)..(253): Utility: Useful for modifying plant architecture, ie amount of branching
MTALVTGGSKGIGEAVVEELATLGARIHTCARDETQLQESLRKWQAKGFQVTTSVCDVSSRDKREKLMETVSTIFEGKLNILVNNVGTCIVKPTLQHTAEDFSFTMATNLESAFHLSQLAHPLLKASGSGSIVLISSVSGVVHVNGASIYGVSKGAMNQLGRNLACEWASDNIRTNSVCPWFIETPLVTESLSNEEFRKEVESRPPMGRVGEVNEVSSLVAFLCLPAASYITGQTICVDGVFTVNGFSFKPLP

SEQ ID NO: 7151 - protein, 271 aa, Arabidopsis thaliana
  misc_feature (1)..(271): useful for making plants with modified plant phenotypes as described in USSN 12/139,269
  misc_feature (1)..(271): Public GI no. 3980399
  misc_feature (1)..(271): Utility: Useful for making ornamental plants with modified flowers
  misc_feature (1)..(271): Utility: Useful for making plants with altered leaf shape eg curled leaves
  misc_feature (1)..(271): Utility: Useful for making plants with increased biomass
  misc_feature (1)..(271): Utility: Useful for making plants with increased biomass and foliage
  misc_feature (1)..(271): Utility: Useful for making shorter plants and plants with modified flowers
  misc_feature (1)..(271): Utility: Useful for making smaller plants
  misc_feature (1)..(271): Utility: Useful for modifying plant architecture, ie amount of branching
MAKTGESLRDKPRWSLVGMTALVTGGSKGIGEAVVEELATLGARIHTCARDETQLQESLRKWQAKGFQVTTSVCDVSSRDKREKLMETVSTIFEGKLNILVNNVGTCIVKPTLQHTAEDFSFTMATNLESAFHLSQLAHPLLKASGSGSIVLISSVSGVVHVNGASIYGVSKGAMNQLGRNLACEWASDNIRTNSVCPWFIETPLVTESLSNEEFRKEVESRPPMGRVGEVNEVSSLVAFLCLPAASYITGQTICVDGGFTVNGFSFKPLP

SEQ ID NO: 7152 - protein, 271 aa, Arabidopsis thaliana
  misc_feature (1)..(271): useful for making plants with modified plant phenotypes as described in USSN 12/139,269
  misc_feature (1)..(271): Public GI no. 21554716
  misc_feature (1)..(271): Utility: Useful for making ornamental plants with modified flowers
  misc_feature (1)..(271): Utility: Useful for making plants with altered leaf shape eg curled leaves
  misc_feature (1)..(271): Utility: Useful for making plants with increased biomass
  misc_feature (1)..(271): Utility: Useful for making plants with increased biomass and foliage
  misc_feature (1)..(271): Utility: Useful for making shorter plants and plants with modified flowers
  misc_feature (1)..(271): Utility: Useful for making smaller plants
  misc_feature (1)..(271): Utility: Useful for modifying plant architecture, ie amount of branching
MAKTGESLRDKPRWSLVGMTALVTGGSKGIGEAVVEELATLGARIHTCARDETQLQESLRKWQAKGFQVTTSVCDVSSRDKREKLMETVSTIFEGKLNILVNNVGTCIVKPTLQHTAEDFSFTMATNLESAFHLSQLAHPLLKASGSGSIVLISSVSGVVHVNGASIYGVSKGAMNQLGRNLACEWASDNIRTNSVCPWFIETPLVTESLSNEEFRKEVESRPPMGRVGEVNEVSSLVAFLCLPAASYITGQTICVDGVFTVNGFSFKPLP

SEQ ID NO: 7153 - protein, 250 aa, Glycine max
  misc_feature (1)..(250): useful for making plants with modified plant phenotypes as described in USSN 12/139,269
  misc_feature (1)..(250): Ceres CLONE ID no. 480984
  misc_feature (1)..(250): Utility: Useful for making ornamental plants with modified flowers
  misc_feature (1)..(250): Utility: Useful for making plants with altered leaf shape eg curled leaves
  misc_feature (1)..(250): Utility: Useful for making plants with increased biomass
  misc_feature (1)..(250): Utility: Useful for making plants with increased biomass and foliage
  misc_feature (1)..(250): Utility: Useful for making shorter plants and plants with modified flowers
  misc_feature (1)..(250): Utility: Useful for making smaller plants
  misc_feature (1)..(250): Utility: Useful for modifying plant architecture, ie amount of branching
MTALVTGGSKGIGYAIVEELAQLGATVHTCARNEAELNESLNEWNTKGYRVTGSVCDVASRAERQDLIARVSNEFNGKLNILVNNVGTNVPKHTLDVTEEDFSFLINTNLESAYHLSQLAHPLLKASEAANIIFISSIAGVLSIGIGSTYGATKGAMNQLTKNLACEWAKDNIRTNCVAPGPIKTPLGDKHFKNEKLLNAFISQTPLGRIGEAEEVSSLVAFLCLPAASYITGQTICVDGGLTVNGLYIN

SEQ ID NO: 7154 - protein, 251 aa, Glycine max
  misc_feature (1)..(251): useful for making plants with modified plant phenotypes as described in USSN 12/139,269
  misc_feature (1)..(251): Ceres CLONE ID no. 1371320
  misc_feature (1)..(251): Utility: Useful for making ornamental plants with modified flowers
  misc_feature (1)..(251): Utility: Useful for making plants with altered leaf shape eg curled leaves
  misc_feature (1)..(251): Utility: Useful for making plants with increased biomass
  misc_feature (1)..(251): Utility: Useful for making plants with increased biomass and foliage
  misc_feature (1)..(251): Utility: Useful for making shorter plants and plants with modified flowers
  misc_feature (1)..(251): Utility: Useful for making smaller plants
  misc_feature (1)..(251): Utility: Useful for modifying plant architecture, ie amount of branching
MTALVTGGSKGIGYAIVEELAQLGATVHTCARNEAELNKSLNEWNTKGYRVTGSVCDVASRAERQDLIARVSNEFNGKLNILVNNVGTNIQKETLDFTEEDFTFLVNTNLESCFHLSQLAHPLLKASEAANIILISSIAGVVASNIVSVVYGATKGAMNQMTKHLACEWAKDNIRTNCVAPGPIRTPLGDKHFKEEKLNNSLIARTPLGRIGEAEEVSSLVAFLCLPAASYITGQTICVDGGFTVNGLYIS

SEQ ID NO: 7155 - DNA, 632 bp, Arabidopsis thaliana
  misc_feature (1)..(632): useful for making plants with modified plant phenotypes as described in USSN 12/139,269
  misc_feature (1)..(632): Ceres CLONE ID no. 4067
  misc_feature (1)..(632): Also known as  Ceres CDNA ID no. 23359077
cgtcttcgagattgatctgatttgctttgttgttttctttctgctacaagtagataaaaaatggcatggcgcagtgcagcacgctctttcgtctccgctacagctagagctccgtctctccgatctccgccgccaacgcttccccgcctccgtccttcccaatcctctttgccccgccgccgatttgcctctttcactaatcccaggaatttgggagagctaggatgcacagagtcattcttgcctctgtacaatgttgtggctgcagcgagactcacatctcaccttaatgttaatctgcgagctttctgcgaactctctaacggtacttgagaatgcacaaagtggatacatcagttatcttgcagcagttggagacttgagaaaaggggtgtaccaagaagaactcattggttgttttgtgttccattaggaaccaaaaactatatacattatttcgatcttacttcacttttgacaatttccagttttagaatatctggatttctcttcatatttcttgttgtttagcccaatggctttaaatacttgagggtagattcagcaaattcttgaagaaccattgtttcatcgttgtatttataatgttatgaactcccttcgggtttccc

SEQ ID NO: 7156 - protein, 90 aa, Arabidopsis thaliana
  misc_feature (1)..(90): useful for making plants with modified plant phenotypes as described in USSN 12/139,269
  misc_feature (1)..(90): Utility: Useful for making ornamental plants with modified flowers
  misc_feature (1)..(90): Utility: Useful for making plants sterile and for genetic confinement
  misc_feature (1)..(90): Utility: Useful for making plants with increased biomass and foliage
  misc_feature (1)..(90): Utility: Useful for making stronger plants
  misc_feature (1)..(90): Utility: Useful for making taller plants and plants with longer inflorescences
MAWRSAARSFVSATARAPSLRSPPPTLPRLRPSQSSLPRRRFASFTNPRNLGELGCTESFLPLYNVVAAARLTSHLNVNLRAFCELSNGT

SEQ ID NO: 7157 - protein, 90 aa, Brassica napus
  misc_feature (1)..(90): useful for making plants with modified plant phenotypes as described in USSN 12/139,269
  misc_feature (1)..(90): Ceres CLONE ID no. 1117707
  misc_feature (1)..(90): Utility: Useful for making ornamental plants with modified flowers
  misc_feature (1)..(90): Utility: Useful for making plants sterile and for genetic confinement
  misc_feature (1)..(90): Utility: Useful for making plants with increased biomass and foliage
  misc_feature (1)..(90): Utility: Useful for making stronger plants
  misc_feature (1)..(90): Utility: Useful for making taller plants and plants with longer inflorescences
  misc_feature (7)..(7): Xaa is any aa, unknown or other
  misc_feature (8)..(8): Xaa is any aa, unknown or other
MAWRSAXXAARSFVSATARAPSLRPPPATLPRLRPSQSSLPRRRFTNPRNLGELGCTQSLLPLHNVVASARLISHLNLNVRAFCELPNGT

SEQ ID NO: 7158 - protein, 94 aa, Brassica napus
  misc_feature (1)..(94): useful for making plants with modified plant phenotypes as described in USSN 12/139,269
  misc_feature (1)..(94): Ceres CLONE ID no. 873165
  misc_feature (1)..(94): Utility: Useful for making ornamental plants with modified flowers
  misc_feature (1)..(94): Utility: Useful for making plants sterile and for genetic confinement
  misc_feature (1)..(94): Utility: Useful for making plants with increased biomass and foliage
  misc_feature (1)..(94): Utility: Useful for making stronger plants
  misc_feature (1)..(94): Utility: Useful for making taller plants and plants with longer inflorescences
MAWRSAGSAARSFVSATARAPSLRPPPATLPRLRPSQSSLPRRRFTNPRNLGELGCTQSLLPLHNVVASARLISHLNLNVRAFCELPNGNGKDG

SEQ ID NO: 7159 - protein, 93 aa, Arabidopsis thaliana
  misc_feature (1)..(93): useful for making plants with modified plant phenotypes as described in USSN 12/139,269
  misc_feature (1)..(93): Ceres CLONE ID no. 41682
  misc_feature (1)..(93): Utility: Useful for making ornamental plants with modified flowers
  misc_feature (1)..(93): Utility: Useful for making plants sterile and for genetic confinement
  misc_feature (1)..(93): Utility: Useful for making plants with increased biomass and foliage
  misc_feature (1)..(93): Utility: Useful for making stronger plants
  misc_feature (1)..(93): Utility: Useful for making taller plants and plants with longer inflorescences
MAWRNAGSAARSFVSATARSPSLRSPTTALPRLRPPQSSLPSRRFTFSSPSRNLGALGCTQSFLPLYSVVATSQLTSHLNVNLRAFCELSNGT

SEQ ID NO: 7160 - protein, 101 aa, Arabidopsis thaliana
  misc_feature (1)..(101): useful for making plants with modified plant phenotypes as described in USSN 12/139,269
  misc_feature (1)..(101): Ceres CLONE ID no. 1345188
  misc_feature (1)..(101): Utility: Useful for making ornamental plants with modified flowers
  misc_feature (1)..(101): Utility: Useful for making plants sterile and for genetic confinement
  misc_feature (1)..(101): Utility: Useful for making plants with increased biomass and foliage
  misc_feature (1)..(101): Utility: Useful for making stronger plants
  misc_feature (1)..(101): Utility: Useful for making taller plants and plants with longer inflorescences
MAWRNAGSAARSFVSATARSPSLRSPTTALPRLRPPQSSLPSRRFTFSSPSRNLGALGCTQSFLPLYSVVATSQLTSHLNVNLRAFCELSNGTFQRTCQDR

SEQ ID NO: 7161 - protein, 93 aa, Arabidopsis thaliana; identical to SEQ ID NO: 7159
  misc_feature (1)..(93): useful for making plants with modified plant phenotypes as described in USSN 12/139,269
  misc_feature (1)..(93): Public GI no. 30679289
  misc_feature (1)..(93): Utility: Useful for making ornamental plants with modified flowers
  misc_feature (1)..(93): Utility: Useful for making plants sterile and for genetic confinement
  misc_feature (1)..(93): Utility: Useful for making plants with increased biomass and foliage
  misc_feature (1)..(93): Utility: Useful for making stronger plants
  misc_feature (1)..(93): Utility: Useful for making taller plants and plants with longer inflorescences

SEQ ID NO: 7162 - protein, 97 aa, Arabidopsis thaliana
  misc_feature (1)..(97): useful for making plants with modified plant phenotypes as described in USSN 12/139,269
  misc_feature (1)..(97): Public GI no. 21554019
  misc_feature (1)..(97): Utility: Useful for making ornamental plants with modified flowers
  misc_feature (1)..(97): Utility: Useful for making plants sterile and for genetic confinement
  misc_feature (1)..(97): Utility: Useful for making plants with increased biomass and foliage
  misc_feature (1)..(97): Utility: Useful for making stronger plants
  misc_feature (1)..(97): Utility: Useful for making taller plants and plants with longer inflorescences
MAWRNAGSAARSFVSATARSPSLRSPTTALPRLRPPQSSLPSRRFTFSSPSRNLGALGCTQSFLPLYSVVATSQLTSHLNVNLRAFCELSNGIGKDG

SEQ ID NO: 7163 - protein, 93 aa, Brassica napus
  misc_feature (1)..(93): useful for making plants with modified plant phenotypes as described in USSN 12/139,269
  misc_feature (1)..(93): Ceres CLONE ID no. 1090313
  misc_feature (1)..(93): Utility: Useful for making ornamental plants with modified flowers
  misc_feature (1)..(93): Utility: Useful for making plants sterile and for genetic confinement
  misc_feature (1)..(93): Utility: Useful for making plants with increased biomass and foliage
  misc_feature (1)..(93): Utility: Useful for making stronger plants
  misc_feature (1)..(93): Utility: Useful for making taller plants and plants with longer inflorescences
MAWRNAGSTARSFVSAAARAPSLRSPTAALPRLRPSPSSLPGRRSSFSLPSRNIGALGCTQSFLPLYSVVAASQLTSHLNVNLRAFCELSNGT

SEQ ID NO: 7164 - protein, 95 aa, Brassica napus
  misc_feature (1)..(95): useful for making plants with modified plant phenotypes as described in USSN 12/139,269
  misc_feature (1)..(95): Ceres CLONE ID no. 971413
  misc_feature (1)..(95): Utility: Useful for making ornamental plants with modified flowers
  misc_feature (1)..(95): Utility: Useful for making plants sterile and for genetic confinement
  misc_feature (1)..(95): Utility: Useful for making plants with increased biomass and foliage
  misc_feature (1)..(95): Utility: Useful for making stronger plants
  misc_feature (1)..(95): Utility: Useful for making taller plants and plants with longer inflorescences
MAWRNAGSTARSFVSAAARAPSLRSPTAALPRLRPSPSSLPGRRSSFSLPSRNIGALGCTQSFLPLYSVVAASQLTSHLNVNLRAFCELSNAIKR

SEQ ID NO: 7165 - protein, 93 aa, Brassica napus
  misc_feature (1)..(93): useful for making plants with modified plant phenotypes as described in USSN 12/139,269
  misc_feature (1)..(93): Ceres CLONE ID no. 966070
  misc_feature (1)..(93): Utility: Useful for making ornamental plants with modified flowers
  misc_feature (1)..(93): Utility: Useful for making plants sterile and for genetic confinement
  misc_feature (1)..(93): Utility: Useful for making plants with increased biomass and foliage
  misc_feature (1)..(93): Utility: Useful for making stronger plants
  misc_feature (1)..(93): Utility: Useful for making taller plants and plants with longer inflorescences
  misc_feature (37)..(37): Xaa is any aa, unknown or other
  misc_feature (43)..(43): Xaa is any aa, unknown or other
MAWRNARSAARSFAAATARAPSLRTPTTALPRLRPSXSSSPGXRFSFSSPSRNLGALGCTQSFLPLYSVVAASQLTSHLNVNLRAFCELPNGT

SEQ ID NO: 7166 - protein, 98 aa, Glycine max
  misc_feature (1)..(98): useful for making plants with modified plant phenotypes as described in USSN 12/139,269
  misc_feature (1)..(98): Ceres CLONE ID no. 719050
  misc_feature (1)..(98): Utility: Useful for making ornamental plants with modified flowers
  misc_feature (1)..(98): Utility: Useful for making plants sterile and for genetic confinement
  misc_feature (1)..(98): Utility: Useful for making plants with increased biomass and foliage
  misc_feature (1)..(98): Utility: Useful for making stronger plants
  misc_feature (1)..(98): Utility: Useful for making taller plants and plants with longer inflorescences
MAFRSGSLSRSLMSTARASLRPAAPSSTLPRLRPPPLAAPRVQSRRFSMPASRNLGQLGCTHSLLPLGITCMTSHIAVSARACCELSHGTFRRSCQDR

SEQ ID NO: 7167 - protein, 89 aa, Glycine max
  misc_feature (1)..(89): useful for making plants with modified plant phenotypes as described in USSN 12/139,269
  misc_feature (1)..(89): Ceres CLONE ID no. 708048
  misc_feature (1)..(89): Utility: Useful for making ornamental plants with modified flowers
  misc_feature (1)..(89): Utility: Useful for making plants sterile and for genetic confinement
  misc_feature (1)..(89): Utility: Useful for making plants with increased biomass and foliage
  misc_feature (1)..(89): Utility: Useful for making stronger plants
  misc_feature (1)..(89): Utility: Useful for making taller plants and plants with longer inflorescences
MAWRCGSLSRSVLSAARTIPTRSSISPLSPSLRSHLLHSRRPLNTLPRTVGILVCTHSLMPLHSADASARLTSHISVESRACCELSQGT

SEQ ID NO: 7168 - DNA, 712 bp, Arabidopsis thaliana; identical to SEQ ID NO: 5203
  misc_feature (1)..(712): useful for making plants with modified plant phenotypes as described in USSN 12/139,269
  misc_feature (1)..(712): Ceres CLONE ID no. 4734
  misc_feature (1)..(712): Also known as  Ceres CDNA ID no. 23384140

SEQ ID NO: 7169 - protein, 92 aa, Arabidopsis thaliana; identical to SEQ ID NO: 5204
  misc_feature (1)..(92): useful for making plants with modified plant phenotypes as described in USSN 12/139,269
  misc_feature (1)..(92): Utility: Useful for making ornamental plants with modified flowers
  misc_feature (1)..(92): Utility: Useful for making plants with enhanced abiotic stress tolerance

SEQ ID NO: 7170 - protein, 92 aa, Brassica napus
  misc_feature (1)..(92): useful for making plants with modified plant phenotypes as described in USSN 12/139,269
  misc_feature (1)..(92): Ceres CLONE ID no. 951040
  misc_feature (1)..(92): Utility: Useful for making ornamental plants with modified flowers
  misc_feature (1)..(92): Utility: Useful for making plants with enhanced abiotic stress tolerance
MSNRRSRQSSSAPRISDDQIIDLVTKLRQILPEIGQRRRSDKVSASKVLQETCNYIRNLNREVDNLSERLAQLLESVDEDSPQAAVIRSLLM

SEQ ID NO: 7171 - protein, 92 aa, Brassica napus
  misc_feature (1)..(92): useful for making plants with modified plant phenotypes as described in USSN 12/139,269
  misc_feature (1)..(92): Public GI no. 9294226
  misc_feature (1)..(92): Utility: Useful for making ornamental plants with modified flowers
  misc_feature (1)..(92): Utility: Useful for making plants with enhanced abiotic stress tolerance
MSNRRSRQTSNASRISDDQMIDLVSKLRQFLPEIHERRRSDKVSASKVLQETCNYIRKLHREVDNLSDRLSQLLDSVDEDSPEAAVIRSLLM

SEQ ID NO: 7172 - protein, 91 aa, Triticum aestivum; identical to SEQ ID NO: 5208
  misc_feature (1)..(91): useful for making plants with modified plant phenotypes as described in USSN 12/139,269
  misc_feature (1)..(91): Ceres CLONE ID no. 703180
  misc_feature (1)..(91): Utility: Useful for making ornamental plants with modified flowers
  misc_feature (1)..(91): Utility: Useful for making plants with enhanced abiotic stress tolerance

SEQ ID NO: 7173 - protein, 91 aa, Glycine max; identical to SEQ ID NO: 5208
  misc_feature (1)..(91): useful for making plants with modified plant phenotypes as described in USSN 12/139,269
  misc_feature (1)..(91): Ceres CLONE ID no. 560681
  misc_feature (1)..(91): Utility: Useful for making ornamental plants with modified flowers
  misc_feature (1)..(91): Utility: Useful for making plants with enhanced abiotic stress tolerance

SEQ ID NO: 7174 - DNA, 565 bp, Arabidopsis thaliana
  misc_feature (1)..(565): useful for making plants with modified plant phenotypes as described in USSN 12/139,269
  misc_feature (1)..(565): Ceres CLONE ID no. 13391
  misc_feature (1)..(565): Also known as  Ceres CDNA ID no. 23396186
atttcaagctcagaccaaactaaacaaactcgtctacatttgaagaactcaaaaacaagatcaaagaaggaagatcattaatggcggaaccaaaacaaagctctctttctgaggtgaagacaaatgtgattggaagcagaaaagaagagaaggaatcgatgtttcatgggaaagagactcatggaagaagtgaagacattgatgagaagacaagggttgatgatgttaaaggacctggtgttctcgggcgtatgatggaagaaatggaagccattgttgacgctgttactcctaacaaaagttctgacaagtaaaatgattagtatcgtttctagttcctaagatccggtcacaaactatatacttctgttgtaagaactgtaaccaccccctttgcttaataaagacacgagcttttagattcttgacaacaccatatctatagatttcaatgaagagattaagaacacaaaatcaaaagaatgactctctttttattagtctaggaaaattcctcaaaacctaaactctcaatgtattctacaactctctcaaaggctatgtt

SEQ ID NO: 7175 - protein, 77 aa, Arabidopsis thaliana
  misc_feature (1)..(77): useful for making plants with modified plant phenotypes as described in USSN 12/139,269
  misc_feature (1)..(77): Utility: Useful for making ornamental plants with modified flowers
  misc_feature (1)..(77): Utility: Useful for making plants sterile and for genetic confinement
  misc_feature (1)..(77): Utility: Useful for modifying plant architecture, ie amount of branching
MAEPKQSSLSEVKTNVIGSRKEEKESMFHGKETHGRSEDIDEKTRVDDVKGPGVLGRMMEEMEAIVDAVTPNKSSDK

SEQ ID NO: 7176 - DNA, 671 bp, Arabidopsis thaliana
  misc_feature (1)..(671): useful for making plants with modified plant phenotypes as described in USSN 12/139,269
  misc_feature (1)..(671): Ceres CLONE ID no. 28643
  misc_feature (1)..(671): Also known as  Ceres CDNA ID no. 23371583
cttccaaagccgctgcgaaactcgtcgattttcaaaaccggagctcagagactgatctcggaaagtaaatcgcagccatggcggaaaaagctgtcactatcaagaccagaaacttcatgaccaacaggcttctcgccagaaagcaattcgttattgatgttcttcatcctggaagagccaatgtttcaaaggctgagcttaaggagaaattggcgaggatgtatgaggttaaggacccaaatgctatcttctgtttcaagttcagaactcactttggaggtggtaaatcttctggatatggtttgatctatgatactgtcgagaacgctaagaagtttgagcctaagtacagacttatcaggaatggacttgacaccaagattgagaaatcaaggaaacagatcaaggagaggaagaacagggcgaagaagatccgtggtgttaagaagaccaaggctggtgatgccaagaagaagtaagacgtttgaagaggacagaagcagcaatatggtttttgttctgcatcactcctttgaagccatgtttgctattagacatcttctaattatttctcgattttgtgcttctttttgtcacacttgctctattttggtttggatcttgttttagagaaacatgtggttaagattttgtttgaatacattgatttt

SEQ ID NO: 7177 - protein, 133 aa, Arabidopsis thaliana
  misc_feature (1)..(133): useful for making plants with modified plant phenotypes as described in USSN 12/139,269
  misc_feature (24)..(107): Pfam Name: Ribosomal_S24e; Pfam Description: Ribosomal protein S24e
  misc_feature (24)..(107): Pfam Name: Ribosomal_S24e; Pfam Description: Ribosomal protein S24e
  misc_feature (1)..(133): Utility: Useful for making ornamental plants with modified flowers
  misc_feature (1)..(133): Utility: Useful for making plants sterile and for genetic confinement
  misc_feature (1)..(133): Utility: Useful for making taller plants and plants with longer inflorescences
MAEKAVTIKTRNFMTNRLLARKQFVIDVLHPGRANVSKAELKEKLARMYEVKDPNAIFCFKFRTHFGGGKSSGYGLIYDTVENAKKFEPKYRLIRNGLDTKIEKSRKQIKERKNRAKKIRGVKKTKAGDAKKK

SEQ ID NO: 7178 - protein, 133 aa, Arabidopsis thaliana
  misc_feature (1)..(133): useful for making plants with modified plant phenotypes as described in USSN 12/139,269
  misc_feature (1)..(133): Public GI no. 18377454
  misc_feature (1)..(133): Utility: Useful for making ornamental plants with modified flowers
  misc_feature (1)..(133): Utility: Useful for making plants sterile and for genetic confinement
  misc_feature (1)..(133): Utility: Useful for making taller plants and plants with longer inflorescences
MAEKAVTIRTRNFMTNRLLARKQFVIDVLHPGRANVSKAELKEKLARMYEVKDPNAIFCFKFRTHFGGGKSSGYGLIYDTVENAKKFEPKYRLIRNGLDTKIEKSRKQIKERKNRAKKIRGVKKTKAGDTKKK

SEQ ID NO: 7179 - protein, 131 aa, Arabidopsis thaliana
  misc_feature (1)..(131): useful for making plants with modified plant phenotypes as described in USSN 12/139,269
  misc_feature (1)..(131): Ceres CLONE ID no. 27627
  misc_feature (1)..(131): Utility: Useful for making ornamental plants with modified flowers
  misc_feature (1)..(131): Utility: Useful for making plants sterile and for genetic confinement
  misc_feature (1)..(131): Utility: Useful for making taller plants and plants with longer inflorescences
MAEKAVTIRTRNFMTNRLLARKQFVIDVLHPGRANVSKAELKEKLARMYEVKDPNAIFCFRTHFGGGKSSGYGLIYDTVENAKKFEPKYRLIRNGLDTNIEKSRKQIKERKNRAKKIRGVKKTKAGDAKKK

SEQ ID NO: 7180 - protein, 133 aa, Arabidopsis thaliana
  misc_feature (1)..(133): useful for making plants with modified plant phenotypes as described in USSN 12/139,269
  misc_feature (1)..(133): Ceres CLONE ID no. 25350
  misc_feature (1)..(133): Utility: Useful for making ornamental plants with modified flowers
  misc_feature (1)..(133): Utility: Useful for making plants sterile and for genetic confinement
  misc_feature (1)..(133): Utility: Useful for making taller plants and plants with longer inflorescences
MAEKAVTIRTRKFMTNRLLSRKQFVIDVLHPGRANVSKAELKEKLARMYEVKDPNAIFVFKFRTHFGGGKSSGFGLIYDTVESAKKFEPKYRLIRNGLDTKIEKSRKQIKERKNRAKKIRGVKKTKAGDAKKK

SEQ ID NO: 7181 - protein, 133 aa, Arabidopsis thaliana; identical to SEQ ID NO: 7180
  misc_feature (1)..(133): useful for making plants with modified plant phenotypes as described in USSN 12/139,269
  misc_feature (1)..(133): Public GI no. 21554374
  misc_feature (1)..(133): Utility: Useful for making ornamental plants with modified flowers
  misc_feature (1)..(133): Utility: Useful for making plants sterile and for genetic confinement
  misc_feature (1)..(133): Utility: Useful for making taller plants and plants with longer inflorescences

SEQ ID NO: 7182 - protein, 156 aa, Brassica napus
  misc_feature (1)..(156): useful for making plants with modified plant phenotypes as described in USSN 12/139,269
  misc_feature (1)..(156): Ceres CLONE ID no. 1123729
  misc_feature (1)..(156): Utility: Useful for making ornamental plants with modified flowers
  misc_feature (1)..(156): Utility: Useful for making plants sterile and for genetic confinement
  misc_feature (1)..(156): Utility: Useful for making taller plants and plants with longer inflorescences
SFFSPLPTNERTNELKASQRDLTMAEKAVTIRTRKFMTNRLLSRKQFVIDVLHPGRANVSKAELKEKLARMYEVKDPNAIFVFKFRTHFGGGKSSGFGLIYDNVESAKKFEPKYRLIRNGLDTKIEKSRKQIKERKNRAKKIRGVKKTKAGDPKKK

SEQ ID NO: 7183 - protein, 133 aa, Zea mays
  misc_feature (1)..(133): useful for making plants with modified plant phenotypes as described in USSN 12/139,269
  misc_feature (1)..(133): Ceres CLONE ID no. 1372632
  misc_feature (1)..(133): Utility: Useful for making ornamental plants with modified flowers
  misc_feature (1)..(133): Utility: Useful for making plants sterile and for genetic confinement
  misc_feature (1)..(133): Utility: Useful for making taller plants and plants with longer inflorescences
MAEKAVTIRTRKFMTNRLLSRKQFVIDVLHPGRANVSKAELKEKLARMYEVKDPNAIFVFKFRTHFGGGKSSGFGLIYDNVESAKKFEPKYRLIRNGLDTKIEKSRKQIKERKNRAKKIRGVKKTKAGDPKKK

SEQ ID NO: 7184 - protein, 133 aa, Zea mays; identical to SEQ ID NO: 7183
  misc_feature (1)..(133): useful for making plants with modified plant phenotypes as described in USSN 12/139,269
  misc_feature (1)..(133): Ceres CLONE ID no. 1374198
  misc_feature (1)..(133): Utility: Useful for making ornamental plants with modified flowers
  misc_feature (1)..(133): Utility: Useful for making plants sterile and for genetic confinement
  misc_feature (1)..(133): Utility: Useful for making taller plants and plants with longer inflorescences

SEQ ID NO: 7185 - protein, 153 aa, Zea mays
  misc_feature (1)..(153): useful for making plants with modified plant phenotypes as described in USSN 12/139,269
  misc_feature (1)..(153): Ceres CLONE ID no. 1421186
  misc_feature (1)..(153): Utility: Useful for making ornamental plants with modified flowers
  misc_feature (1)..(153): Utility: Useful for making plants sterile and for genetic confinement
  misc_feature (1)..(153): Utility: Useful for making taller plants and plants with longer inflorescences
FRSRSERVANRRELGGIAAAMAEKAVTIRTRKFMTNRLLSRKQFVIDVLHPGRANVSKAELKEKLARMYEVKDPNAIFVFKFRTHFGGGKSSGFGLIYDNVESAKKFEPKYRLIRNGLDTKIEKSRKQIKERKNRAKKIRGVKKTKAGDPKKK

SEQ ID NO: 7186 - protein, 133 aa, Brassica napus
  misc_feature (1)..(133): useful for making plants with modified plant phenotypes as described in USSN 12/139,269
  misc_feature (1)..(133): Ceres CLONE ID no. 1078224
  misc_feature (1)..(133): Utility: Useful for making ornamental plants with modified flowers
  misc_feature (1)..(133): Utility: Useful for making plants sterile and for genetic confinement
  misc_feature (1)..(133): Utility: Useful for making taller plants and plants with longer inflorescences
MSEKAVTIRTRKFMTNRLLSRKQFVIDVLHPGRANVSKAELKEKLARMYEVKDPNAIFVFKFRTHFGGGKSSGFGLIYDNVESAKKFEPKYRLIRNGLDTKIEKSRKQIKERKNRAKKIRGVKKTKAGDPKKK

SEQ ID NO: 7187 - protein, 156 aa, Brassica napus
  misc_feature (1)..(156): useful for making plants with modified plant phenotypes as described in USSN 12/139,269
  misc_feature (1)..(156): Ceres CLONE ID no. 1039916
  misc_feature (1)..(156): Utility: Useful for making ornamental plants with modified flowers
  misc_feature (1)..(156): Utility: Useful for making plants sterile and for genetic confinement
  misc_feature (1)..(156): Utility: Useful for making taller plants and plants with longer inflorescences
YPPLSSLPVIFSLSLSQSAKIATMAEKAVTIRARKFMTNRLLSRKQFVIDVLHPGRANVSKAELKEKLARMYEVKDPNAIFVFKFRTHFGGGKSSGFGLIYDNVESAKKFEPKYRLIRNGLDTKIEKSRKQIKERKNRAKKIRGVKKTKAGDPKKK

SEQ ID NO: 7188 - protein, 132 aa, Glycine max
  misc_feature (1)..(132): useful for making plants with modified plant phenotypes as described in USSN 12/139,269
  misc_feature (1)..(132): Ceres CLONE ID no. 1051017
  misc_feature (1)..(132): Utility: Useful for making ornamental plants with modified flowers
  misc_feature (1)..(132): Utility: Useful for making plants sterile and for genetic confinement
  misc_feature (1)..(132): Utility: Useful for making taller plants and plants with longer inflorescences
  misc_feature (49)..(49): Xaa is any aa, unknown or other
  misc_feature (52)..(52): Xaa is any aa, unknown or other
  misc_feature (123)..(123): Xaa is any aa, unknown or other
MAEKAVTIRTRKFMTNRLLSRKQFVIDVLHPGRANVSKAELKEKLARMXEVXDPNAIFVFKFRTHFGGGKSSGFGLIYDNVESAKKFEPKYRLIRNGLDTKIEKSRKQIKERKNRAKKIRGVXKTKAGDPKK

SEQ ID NO: 7189 - protein, 133 aa, Glycine max
  misc_feature (1)..(133): useful for making plants with modified plant phenotypes as described in USSN 12/139,269
  misc_feature (1)..(133): Public GI no. 445612
  misc_feature (1)..(133): Utility: Useful for making ornamental plants with modified flowers
  misc_feature (1)..(133): Utility: Useful for making plants sterile and for genetic confinement
  misc_feature (1)..(133): Utility: Useful for making taller plants and plants with longer inflorescences
MADKAVTIRTRKFMTNRLLARKQFIIDVLHPGRANVSKAELKEKLARMYEVKDTNAIFVFKFRTHFGGGKSTGFGLIYDSVENAKKYEPKYRLIRNGLDTKVEKSRKQMKERKNRAKKVRGVKKIKAGDAKKK

SEQ ID NO: 7190 - DNA, 701 bp, Triticum aestivum; identical to SEQ ID NO: 5213
  misc_feature (1)..(701): useful for making plants with modified plant phenotypes as described in USSN 12/139,269
  misc_feature (1)..(701): Ceres CLONE ID no. 733804
  misc_feature (1)..(701): Also known as  Ceres CDNA ID no. 23398793
  misc_feature (622)..(622): y is t/u or c

SEQ ID NO: 7191 - protein, 92 aa, Triticum aestivum; identical to SEQ ID NO: 5214
  misc_feature (1)..(92): useful for making plants with modified plant phenotypes as described in USSN 12/139,269
  misc_feature (1)..(92): Utility: Useful for making ornamental plants with modified flowers
  misc_feature (1)..(92): Utility: Useful for making plants tolerant to low nitrogen

SEQ ID NO: 7192 - protein, 92 aa, Glycine max; identical to SEQ ID NO: 5212
  misc_feature (1)..(92): useful for making plants with modified plant phenotypes as described in USSN 12/139,269
  misc_feature (1)..(92): Ceres CLONE ID no. 653656
  misc_feature (1)..(92): Utility: Useful for making ornamental plants with modified flowers
  misc_feature (1)..(92): Utility: Useful for making plants tolerant to low nitrogen

SEQ ID NO: 7193 - protein, 92 aa, Glycine max; identical to SEQ ID NO: 5218
  misc_feature (1)..(92): useful for making plants with modified plant phenotypes as described in USSN 12/139,269
  misc_feature (1)..(92): Ceres CLONE ID no. 663844
  misc_feature (1)..(92): Utility: Useful for making ornamental plants with modified flowers
  misc_feature (1)..(92): Utility: Useful for making plants tolerant to low nitrogen

SEQ ID NO: 7194 - protein, 94 aa, Glycine max
  misc_feature (1)..(94): useful for making plants with modified plant phenotypes as described in USSN 12/139,269
  misc_feature (1)..(94): Public GI no. 28416803
  misc_feature (1)..(94): Utility: Useful for making ornamental plants with modified flowers
  misc_feature (1)..(94): Utility: Useful for making plants tolerant to low nitrogen
MSSRRSSRSRQSGSSRISDDQISDLVSKLQHLIPELRRRRSDKVSASKVLQETCNYIRNLHREVDDLSDRLSELLASTDDNSAEAAIIRSLLNY

SEQ ID NO: 7195 - protein, 94 aa, Arabidopsis thaliana; identical to SEQ ID NO: 5200
  misc_feature (1)..(94): useful for making plants with modified plant phenotypes as described in USSN 12/139,269
  misc_feature (1)..(94): Ceres CLONE ID no. 18200
  misc_feature (1)..(94): Utility: Useful for making ornamental plants with modified flowers
  misc_feature (1)..(94): Utility: Useful for making plants tolerant to low nitrogen

SEQ ID NO: 7196 - protein, 90 aa, Glycine max
  misc_feature (1)..(90): useful for making plants with modified plant phenotypes as described in USSN 12/139,269
  misc_feature (1)..(90): Ceres CLONE ID no. 1247092
  misc_feature (1)..(90): Utility: Useful for making ornamental plants with modified flowers
  misc_feature (1)..(90): Utility: Useful for making plants tolerant to low nitrogen
MSGRRSRSRQSSGISEDQINDLIIKLQQLLPELRNSRRSDKVSASRVLQETCNYIRNLHREVDDLSERLSELLANTDTAQAALIRSLLTQ

SEQ ID NO: 7197 - protein, 91 aa, Glycine max; identical to SEQ ID NO: 5208
  misc_feature (1)..(91): useful for making plants with modified plant phenotypes as described in USSN 12/139,269
  misc_feature (1)..(91): Ceres CLONE ID no. 560681
  misc_feature (1)..(91): Utility: Useful for making ornamental plants with modified flowers
  misc_feature (1)..(91): Utility: Useful for making plants tolerant to low nitrogen

SEQ ID NO: 7198 - protein, 91 aa, Glycine max; identical to SEQ ID NO: 5208
  misc_feature (1)..(91): useful for making plants with modified plant phenotypes as described in USSN 12/139,269
  misc_feature (1)..(91): Ceres CLONE ID no. 562428
  misc_feature (1)..(91): Utility: Useful for making ornamental plants with modified flowers
  misc_feature (1)..(91): Utility: Useful for making plants tolerant to low nitrogen

SEQ ID NO: 7199 - protein, 88 aa, Glycine max; identical to SEQ ID NO: 5228
  misc_feature (1)..(88): useful for making plants with modified plant phenotypes as described in USSN 12/139,269
  misc_feature (1)..(88): Public GI no. 31431968
  misc_feature (1)..(88): Utility: Useful for making ornamental plants with modified flowers
  misc_feature (1)..(88): Utility: Useful for making plants tolerant to low nitrogen

SEQ ID NO: 7200 - protein, 74 aa, Zea mays
  misc_feature (1)..(74): useful for making plants with modified plant phenotypes as described in USSN 12/139,269
  misc_feature (1)..(74): Ceres CLONE ID no. 486120
  misc_feature (1)..(74): Utility: Useful for making ornamental plants with modified flowers
  misc_feature (1)..(74): Utility: Useful for making plants tolerant to low nitrogen
MNELVSKLQALLPSSRRRRGSGQASTAKLLKETCSYIKSLQREVDDLSDRLSDLLSTMDHNSPAAEIIRSILRS

SEQ ID NO: 7201 - protein, 89 aa, Zea mays; identical to SEQ ID NO: 5231
  misc_feature (1)..(89): useful for making plants with modified plant phenotypes as described in USSN 12/139,269
  misc_feature (1)..(89): Ceres CLONE ID no. 503296
  misc_feature (1)..(89): Utility: Useful for making ornamental plants with modified flowers
  misc_feature (1)..(89): Utility: Useful for making plants tolerant to low nitrogen

SEQ ID NO: 7202 - DNA, 620 bp, Arabidopsis thaliana
  misc_feature (1)..(620): useful for making plants with modified plant phenotypes as described in USSN 12/139,269
  misc_feature (1)..(620): Ceres CLONE ID no. 9221
  misc_feature (1)..(620): Also known as  Ceres CDNA ID no. 23416919
gttgtcttcagctgtgtacagaatcaagtttccaagagagaaagagagtaaaagcaaattaacaaaggaagactctgattcaccgagaaggttttggcttaaagatgacgaacactcgcgcgatctacgccgtcatcgcgatcctggcgatagtaatctcagccgtggaatcaaccggagacttcggagattcgctagatttcgtgagagccggatcttcatcgctcttctctggatgcacaggatcgatcgcagagtgtatagcggaagaagaagagatggagttcgattcagacataagccggcgtatattagcacagaagaagtacattagctacggtgctatgaggaggaacagtgtgccttgttcacggcgtggtgcgtcgtactacaactgccagcgtggagctcaggcgaatccttacagccgtggatgcagcaccatcactaggtgcaggcgttgaagaagatgagtcacttgaatttcctattttgcccctttctttttgtgtctctgtctctcttctcgattttcatttttttaattatttttattttccgggatatatgggtttgattttacacattgaaaaaaaacttctactatagtctttgatttg

SEQ ID NO: 7203 - protein, 119 aa, Arabidopsis thaliana
  misc_feature (1)..(119): useful for making plants with modified plant phenotypes as described in USSN 12/139,269
  misc_feature (55)..(119): Pfam Name: RALF; Pfam Description: Rapid ALkalinization Factor (RALF)
  misc_feature (1)..(119): Utility: Useful for making ornamental plants with modified leaves
  misc_feature (1)..(119): Utility: Useful for making plants with altered leaf shape eg curled leaves
  misc_feature (1)..(119): Utility: Useful for making plants with increased biomass and foliage
  misc_feature (1)..(119): Utility: Useful for making smaller plants
MTNTRAIYAVIAILAIVISAVESTGDFGDSLDFVRAGSSSLFSGCTGSIAECIAEEEEMEFDSDISRRILAQKKYISYGAMRRNSVPCSRRGASYYNCQRGAQANPYSRGCSTITRCRR

SEQ ID NO: 7204 - protein, 119 aa, Brassica napus
  misc_feature (1)..(119): useful for making plants with modified plant phenotypes as described in USSN 12/139,269
  misc_feature (1)..(119): Ceres CLONE ID no. 975562
  misc_feature (1)..(119): Utility: Useful for making ornamental plants with modified leaves
  misc_feature (1)..(119): Utility: Useful for making plants with altered leaf shape eg curled leaves
  misc_feature (1)..(119): Utility: Useful for making plants with increased biomass and foliage
  misc_feature (1)..(119): Utility: Useful for making smaller plants
MNSRAIYAVVAILAIVISAVDASGFGFGHSLDFVRTGSSTLFSGCEGSIAECIAEEEEMEFDSDISRRILAQKKYVSYGAMRKNSVPCSRRGASYYNCQRGAQANPYRRGCSTITRCRR

SEQ ID NO: 7205 - protein, 107 aa, Glycine max
  misc_feature (1)..(107): useful for making plants with modified plant phenotypes as described in USSN 12/139,269
  misc_feature (1)..(107): Ceres CLONE ID no. 706764
  misc_feature (1)..(107): Utility: Useful for making ornamental plants with modified leaves
  misc_feature (1)..(107): Utility: Useful for making plants with altered leaf shape eg curled leaves
  misc_feature (1)..(107): Utility: Useful for making plants with increased biomass and foliage
  misc_feature (1)..(107): Utility: Useful for making smaller plants
MANTYSWLFLAICATLLLLLSSSPTADAGALGMEMTWIPSMPMEEEFQLDSEISRRILATTKYISYGALQRNTVPCSRRGASYYNCQPGAQANPYSRGCSAITRCRS

SEQ ID NO: 7206 - protein, 107 aa, Glycine max
  misc_feature (1)..(107): useful for making plants with modified plant phenotypes as described in USSN 12/139,269
  misc_feature (1)..(107): Ceres CLONE ID no. 588880
  misc_feature (1)..(107): Utility: Useful for making ornamental plants with modified leaves
  misc_feature (1)..(107): Utility: Useful for making plants with altered leaf shape eg curled leaves
  misc_feature (1)..(107): Utility: Useful for making plants with increased biomass and foliage
  misc_feature (1)..(107): Utility: Useful for making smaller plants
MANSYTWLFLAISATLLLLLSSSPTADAGALGMEMTWIPSMPMEEEFQLDSEISRRILATTKYISYGALQRNTVPCSRRGASYYNCQPGAQANPYSRGCSAITRCRS

SEQ ID NO: 7207 - protein, 115 aa, Glycine max
  misc_feature (1)..(115): useful for making plants with modified plant phenotypes as described in USSN 12/139,269
  misc_feature (1)..(115): Public GI no. 16566316
  misc_feature (1)..(115): Utility: Useful for making ornamental plants with modified leaves
  misc_feature (1)..(115): Utility: Useful for making plants with altered leaf shape eg curled leaves
  misc_feature (1)..(115): Utility: Useful for making plants with increased biomass and foliage
  misc_feature (1)..(115): Utility: Useful for making smaller plants
MGVPSGLILCVLIGAFFISMAAAGDSGAYDWVMPARSGGGCKGSIGECIAEEEEFELDSESNRRILATKKYISYGALQKNSVPCSRRGASYYNCKPGAQANPYSRGCSAITRCRS

SEQ ID NO: 7208 - protein, 116 aa, Arabidopsis thaliana
  misc_feature (1)..(116): useful for making plants with modified plant phenotypes as described in USSN 12/139,269
  misc_feature (1)..(116): Ceres CLONE ID no. 5455
  misc_feature (1)..(116): Utility: Useful for making ornamental plants with modified leaves
  misc_feature (1)..(116): Utility: Useful for making plants with altered leaf shape eg curled leaves
  misc_feature (1)..(116): Utility: Useful for making plants with increased biomass and foliage
  misc_feature (1)..(116): Utility: Useful for making smaller plants
MRGLSTKPVAIIIAILTVHFLFAAVTSQSSGDFVPIESKCNGTIAECSLSTAEEEFEMDSEINRRILATTKYISYGALRRNTVPCSRRGASYYNCRRGAQANPYSRGCSAITRCRR

SEQ ID NO: 7209 - protein, 115 aa, Arabidopsis thaliana
  misc_feature (1)..(115): useful for making plants with modified plant phenotypes as described in USSN 12/139,269
  misc_feature (1)..(115): Public GI no. 42374767
  misc_feature (1)..(115): Utility: Useful for making ornamental plants with modified leaves
  misc_feature (1)..(115): Utility: Useful for making plants with altered leaf shape eg curled leaves
  misc_feature (1)..(115): Utility: Useful for making plants with increased biomass and foliage
  misc_feature (1)..(115): Utility: Useful for making smaller plants
MGVPSGLILCVLIGAFFISMATAGDSGAYDWVMPARSGRGCNGSIGECMAEEDEFELDSESNRRILATKKYISYGALQKNSVPCSRRGASYYNCKPGAQANPYSRGCSAITRCRS

SEQ ID NO: 7210 - protein, 120 aa, Arabidopsis thaliana
  misc_feature (1)..(120): useful for making plants with modified plant phenotypes as described in USSN 12/139,269
  misc_feature (1)..(120): Public GI no. 28628203
  misc_feature (1)..(120): Utility: Useful for making ornamental plants with modified leaves
  misc_feature (1)..(120): Utility: Useful for making plants with altered leaf shape eg curled leaves
  misc_feature (1)..(120): Utility: Useful for making plants with increased biomass and foliage
  misc_feature (1)..(120): Utility: Useful for making smaller plants
MAKWSSWFLISATILILMAMGLSSTVQGSGDHHLGWIPATRSSVCKGSIAECMAEDGEEFEMDTEINRRILATTKYVSYGALQRNNVPCSRRGASYYNCQRGAQANPYSRGCSRITRCRS

SEQ ID NO: 7211 - protein, 114 aa, Arabidopsis thaliana
  misc_feature (1)..(114): useful for making plants with modified plant phenotypes as described in USSN 12/139,269
  misc_feature (1)..(114): Public GI no. 37695573
  misc_feature (1)..(114): Utility: Useful for making ornamental plants with modified leaves
  misc_feature (1)..(114): Utility: Useful for making plants with altered leaf shape eg curled leaves
  misc_feature (1)..(114): Utility: Useful for making plants with increased biomass and foliage
  misc_feature (1)..(114): Utility: Useful for making smaller plants
MGVPSYLIVCVLVGAFFISMAAAGDNGSYDWMVPARSGECKGSIAECMAEEDEFALDSESNRRILATKKYISYGALQKNSVPCSRRGASYYNCKPGAQANPYTRGCSAITRCRS

SEQ ID NO: 7212 - protein, 120 aa, Glycine max
  misc_feature (1)..(120): useful for making plants with modified plant phenotypes as described in USSN 12/139,269
  misc_feature (1)..(120): Ceres CLONE ID no. 628637
  misc_feature (1)..(120): Utility: Useful for making ornamental plants with modified leaves
  misc_feature (1)..(120): Utility: Useful for making plants with altered leaf shape eg curled leaves
  misc_feature (1)..(120): Utility: Useful for making plants with increased biomass and foliage
  misc_feature (1)..(120): Utility: Useful for making smaller plants
MGSSTTFCAFFLVCTILSVHVAQSSSSTLDLDTFFLPLKSGCRGSVAECSLLAGDDDTEFLMESESNRRILAGRSYISYGALRRNTVPCSRRGASYYNCRPGAQANPYSRGCSAITRCRR

SEQ ID NO: 7213 - protein, 118 aa, Glycine max
  misc_feature (1)..(118): useful for making plants with modified plant phenotypes as described in USSN 12/139,269
  misc_feature (1)..(118): Ceres CLONE ID no. 628130
  misc_feature (1)..(118): Utility: Useful for making ornamental plants with modified leaves
  misc_feature (1)..(118): Utility: Useful for making plants with altered leaf shape eg curled leaves
  misc_feature (1)..(118): Utility: Useful for making plants with increased biomass and foliage
  misc_feature (1)..(118): Utility: Useful for making smaller plants
MGSSTFCAFFLLCAILAVHVAQSSSSTLDLDAFFLPLKSGCRGSVAKCSLLAGDDAEFLMESESNRRILAGRSYISYGALRRNTVPCSRRGASYYNCRPGAQANPYSRGCSAITRCRR

SEQ ID NO: 7214 - protein, 128 aa, Glycine max
  misc_feature (1)..(128): useful for making plants with modified plant phenotypes as described in USSN 12/139,269
  misc_feature (1)..(128): Public GI no. 28628205
  misc_feature (1)..(128): Utility: Useful for making ornamental plants with modified leaves
  misc_feature (1)..(128): Utility: Useful for making plants with altered leaf shape eg curled leaves
  misc_feature (1)..(128): Utility: Useful for making plants with increased biomass and foliage
  misc_feature (1)..(128): Utility: Useful for making smaller plants
MARLNSFFLISATVLILMVMGWPSTVQGNGDHHHHHLGWIPTTATTRSSICDKGSLAECMAEEDGEEFGMDTEINRRILATSRYVSYGALQKNNVPCSRRGASYYNCKNGAQANPYSRGCSRITRCRG

SEQ ID NO: 7215 - protein, 122 aa, Zea mays
  misc_feature (1)..(122): useful for making plants with modified plant phenotypes as described in USSN 12/139,269
  misc_feature (1)..(122): Ceres CLONE ID no. 1061370
  misc_feature (1)..(122): Utility: Useful for making ornamental plants with modified leaves
  misc_feature (1)..(122): Utility: Useful for making plants with altered leaf shape eg curled leaves
  misc_feature (1)..(122): Utility: Useful for making plants with increased biomass and foliage
  misc_feature (1)..(122): Utility: Useful for making smaller plants
MAGVRSLVLLLLVLAVALSASASSIAGGDHLQLGLLSGGAGRGECRGTVAECGGEDAEGELGSASAEAHRRVLQGRGYISYGALRRGTVPCNRRGASYYNCRPGAQANPYHRGCSRITRCRG

SEQ ID NO: 7216 - DNA, 1221 bp, Arabidopsis thaliana
  misc_feature (1)..(1221): useful for making plants with modified plant phenotypes as described in USSN 12/139,269
  misc_feature (1)..(1221): Ceres CLONE ID no. 11929
  misc_feature (1)..(1221): Also known as  Ceres CDNA ID no. 23386200
accacatcaattctctcatatctctctctcactttcgaatatatcttaagataacagagacacatactcttaagtttggtgaagaataagaagacaatgacgaaggaagtggttggtgataagagatctttctccgggaaagactatcaagacccaccacctgaacctctattcgacgctactgagcttgggaagtggtctttctacagagctctcatcgctgagttcatagccactctccttttcctctatgtcactattatgactgtcatcggttacaagagccagaccgatccagccctgaatcctgaccagtgtacaggcgttggcgtccttggtatcgcatgggcctttggtggcatgatcttcatcctcgtctactgcaccgccggcatctctggtgggcatattaatccggcagtgacttttgggctgttgttggctcggaaagtgacgttggtgagagcagtgatgtacatggtggctcagtgcctcggtgccatttgtggtgtggctttggtcaaggccttccagtctgcttacttcacccgctacggtggtggcgcaaatggtctctctgacggttacagcatcggcaccggtgttgcagccgagatcattggtacattcgtcttagtctacaccgtcttctctgccactgatcccaagaggagtgcgcgtgactctcacgttcctgtattggctccattgccaattggatttgcagtgttcatcgttcacttagctacaatcccaatcacgggcactggtatcaaccctgcaagaagtctcggagctgcaatcatctacaacaaggacaaagcttgggaccatcattggatattctgggtgggtccgtttgctggtgcagccatcgcagctttctaccatcagtttgtgttgagggctggtgcgattaaggcgctcgggtctttcaggagccagcctcacgtttaactttgatatgctcttccctgagtacatcaaagagagaaaaagagaagataataagagaggcttgtaattttatcttgtgtagacggttggagccaagtgacgtgtagtactagtatctaatttctagctttggtgaggagagatattttgaagtgtcgcttgcgggccaactttgaattgctacttctatgattaaatctatgtctctactccttgactattaagattgctctatttattagtactaaatattccttatatatg

SEQ ID NO: 7217 - protein, 286 aa, Arabidopsis thaliana
  misc_feature (1)..(286): useful for making plants with modified plant phenotypes as described in USSN 12/139,269
  misc_feature (30)..(265): Pfam Name: MIP; Pfam Description: Major intrinsic protein
  misc_feature (1)..(286): Utility: Useful for making ornamental plants with modified leaves
  misc_feature (1)..(286): Utility: Useful for making plants with altered leaf shape eg curled leaves
MTKEVVGDKRSFSGKDYQDPPPEPLFDATELGKWSFYRALIAEFIATLLFLYVTIMTVIGYKSQTDPALNPDQCTGVGVLGIAWAFGGMIFILVYCTAGISGGHINPAVTFGLLLARKVTLVRAVMYMVAQCLGAICGVALVKAFQSAYFTRYGGGANGLSDGYSIGTGVAAEIIGTFVLVYTVFSATDPKRSARDSHVPVLAPLPIGFAVFIVHLATIPITGTGINPARSLGAAIIYNKDKAWDHHWIFWVGPFAGAAIAAFYHQFVLRAGAIKALGSFRSQPHV

SEQ ID NO: 7218 - protein, 253 aa, Arabidopsis thaliana
  misc_feature (1)..(253): useful for making plants with modified plant phenotypes as described in USSN 12/139,269
  misc_feature (1)..(253): Ceres CLONE ID no. 7108
  misc_feature (1)..(253): Utility: Useful for making ornamental plants with modified leaves
  misc_feature (1)..(253): Utility: Useful for making plants with altered leaf shape eg curled leaves
MGELKSWSFYRALIAEFIATLLFLYVTVATVIGHKKQTGPCDGVGLLGIAWAFGGMIFVLVYCTAGISGGHINPAVTFGLFLARKVSLVRALGYMIAQCLGAICGVGFVKAFMKTPYNTLGGGANTVADGYSKGTALGAEIIGTFVLVYTVFSATDPKRSARDSHIPVLAPLPIGFAVFMVHLATIPITGTGINPARSFGAAVIYNNEKAWDDQWIFWVGPFLGALAAAAYHQYILRASAIKALGSFRSNATN

SEQ ID NO: 7219 - protein, 288 aa, Zea mays
  misc_feature (1)..(288): useful for making plants with modified plant phenotypes as described in USSN 12/139,269
  misc_feature (1)..(288): Ceres CLONE ID no. 275791
  misc_feature (1)..(288): Utility: Useful for making ornamental plants with modified leaves
  misc_feature (1)..(288): Utility: Useful for making plants with altered leaf shape eg curled leaves
MGKEVDVSTLEAGGVRDRDYADPPPAPLIDIDELGKWSLYRAVIAEFVATLLFLYITVATVIGYKHQTDASASGPDAACSGVGILGIAWAFGGMIFILVYCTAGISGGHINPAVTFGLFLARKVSLVRALLYMAAQSLGAICGVALVKGFQSGFYARYGGGANEVSAGYSTGTGLAAEIIGTFVLVYTVFSATDPKRNARDSHVPVLAPLPIGFAVFMVHLATIPITGTGINPARSLGAAVVYNNSKAWSDQWIFWVGPFIGAAIAALYHQIVLRASARGYGSFRSNA

SEQ ID NO: 7220 - protein, 263 aa, Arabidopsis thaliana
  misc_feature (1)..(263): useful for making plants with modified plant phenotypes as described in USSN 12/139,269
  misc_feature (1)..(263): Ceres CLONE ID no. 33231
  misc_feature (1)..(263): Utility: Useful for making ornamental plants with modified leaves
  misc_feature (1)..(263): Utility: Useful for making plants with altered leaf shape eg curled leaves
MEELRKWPLYRAVIAEFVATLLFLYVSILTVIGYKAQTDATAGGVDCGGVGILGIAWAFGGMIFVLVYCTAGISGGHINPAVTVGLFLARKVSLVRTVLYIVAQCLGAICGCGFVKAFQSSYYTRYGGGANELADGYNKGTGLGAEIIGTFVLVYTVFSATDPKRNARDSHVPVLAPLPIGFAVFMVHLATIPITGTGINPARSFGAAVIYNNEKAWDDQWIFWVGPMIGAAAAAFYHQFILRAAAIKALGSFGSFGSFRSFA

SEQ ID NO: 7221 - protein, 253 aa, Zea mays
  misc_feature (1)..(253): useful for making plants with modified plant phenotypes as described in USSN 12/139,269
  misc_feature (1)..(253): Ceres CLONE ID no. 1379318
  misc_feature (1)..(253): Utility: Useful for making ornamental plants with modified leaves
  misc_feature (1)..(253): Utility: Useful for making plants with altered leaf shape eg curled leaves
  misc_feature (102)..(102): Xaa is any aa, unknown or other
MGELKSWSFYRALIAEFIATLLFLYVTVATVIGHKKQTGPCDGVGLLGIAWAFGGMIFVLVYCTAGISGGHINPAVTFGLFLARKVSLVRAVGYMIAQCLGXICGVGFVKAFMKTPYNTLGGGANTVADGYSTGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSSATN

SEQ ID NO: 7222 - protein, 253 aa, Arabidopsis thaliana
  misc_feature (1)..(253): useful for making plants with modified plant phenotypes as described in USSN 12/139,269
  misc_feature (1)..(253): Ceres CLONE ID no. 39154
  misc_feature (1)..(253): Utility: Useful for making ornamental plants with modified leaves
  misc_feature (1)..(253): Utility: Useful for making plants with altered leaf shape eg curled leaves
MGELKSWSFYRALIAEFIATLLFLYVTVATVIGHKKQTGPCDGVGLLGIAWAFGGMIFVLVYCTAGISGGHINPAVTFGLFLARKVSLVRALGYMIAQCLGAICGVGFVKAFMKTPYNTLGGGANTVADGYSKGTALGAEIIGTFVLVYTVFSATDPKRSARDSHIPVLAPLPIGFAVFMVHLATIPITGTGINPARSFGAAVIYNNEKAWDDQWIFWVGPFLGALAAAAYHQYILRASAIKAFGSFRSNATN

SEQ ID NO: 7223 - protein, 285 aa, Arabidopsis thaliana
  misc_feature (1)..(285): useful for making plants with modified plant phenotypes as described in USSN 12/139,269
  misc_feature (1)..(285): Ceres CLONE ID no. 25220
  misc_feature (1)..(285): Utility: Useful for making ornamental plants with modified leaves
  misc_feature (1)..(285): Utility: Useful for making plants with altered leaf shape eg curled leaves
MAKDVEGPEGFQTRDYEDPPPTPFFDADELTKWSLYRAVIAEFVATLLFLYITVLTVIGYKIQSDTKVGGVDCGGVGILGIAWAFGGMIFILVYCTAGISGGHINPAVTFGLFLARKVSLIRAVLYMVAQCLGAICGVGFVKAFQSSYYDRYGGGANSLADGYNTGTGLAAEIIGTFVLVYTVFSATDPKRNARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 7224 - protein, 285 aa, Glycine max
  misc_feature (1)..(285): useful for making plants with modified plant phenotypes as described in USSN 12/139,269
  misc_feature (1)..(285): Ceres CLONE ID no. 546486
  misc_feature (1)..(285): Utility: Useful for making ornamental plants with modified leaves
  misc_feature (1)..(285): Utility: Useful for making plants with altered leaf shape eg curled leaves
  misc_feature (3)..(3): Xaa is any aa, unknown or other
  misc_feature (6)..(6): Xaa is any aa, unknown or other
  misc_feature (24)..(24): Xaa is any aa, unknown or other
MAXDLXTEIQSGLPHKDYHDPPPXPFYDPAELRKWSFFRALIAEFVATLLFLYVTILTVIGYNHQTATAAEPCSGVGVLGIAWAFGGMIFVLVYCTAGISGGHINPAVTFGLFLARKVSLTRAVGYMVAQVLGAISGVGLVKALQKSYYNRYKGGVNMLADGYSKGTGLGAEIIGTFILVYTVFSATDPKRVARDSHVPVLAPLPIGFAVFMVHLATIPITGTGINPARSLGPAVIFNNEKAWDDQWIFWVGPFIGAALAAFYHQSVLMAQAAKALGSFRSSSNL

SEQ ID NO: 7225 - protein, 284 aa, Triticum aestivum
  misc_feature (1)..(284): useful for making plants with modified plant phenotypes as described in USSN 12/139,269
  misc_feature (1)..(284): Ceres CLONE ID no. 909689
  misc_feature (1)..(284): Utility: Useful for making ornamental plants with modified leaves
  misc_feature (1)..(284): Utility: Useful for making plants with altered leaf shape eg curled leaves
METGGGGDFAAKDYTDPPPAPLIDAAELASWSLYRAVIAEFIATLLFLYITVATVIGYKHQTDPAVNSAADAACGGVGVLGIAWAFGGMIFVLVYCTAGISGGHINPAVTFGLFLARKVSLVRALLYMIAQCLGAMCGVGLVKAFRAPTSSGTAAAPTRSPPATPRAPASLRRSSGTFVLVYTVFSATDPKRSARDSHVPVLAPLPIGFAVFMVHLATIPITGTGINPARSLGAAVIYNKDKAWDDQWIFWVGPMIGAAIAAFYHQYILRAGAIKALGSFRSNA

SEQ ID NO: 7226 - protein, 292 aa, Triticum aestivum
  misc_feature (1)..(292): useful for making plants with modified plant phenotypes as described in USSN 12/139,269
  misc_feature (1)..(292): Ceres CLONE ID no. 868632
  misc_feature (1)..(292): Utility: Useful for making ornamental plants with modified leaves
  misc_feature (1)..(292): Utility: Useful for making plants with altered leaf shape eg curled leaves
MEGKEEDVRLGANRYSEHQPIGTAAQGGGADKKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 7227 - DNA, 796 bp, Arabidopsis thaliana
  misc_feature (1)..(796): useful for making plants with modified plant phenotypes as described in USSN 12/139,269
  misc_feature (1)..(796): Ceres CLONE ID no. 12071
  misc_feature (1)..(796): Also known as  Ceres CDNA ID no. 23366608
aacctattagagtttccttcctccaacaaaccatctttataagactccaaaatggagggtaagagatcacaaggacaaggttacatgaaaaagaagtcttaccttgtggaagaagatatggagactgatacggatgaagaagaggaagtaggtagggatagagttagagggtctagaggtagcatcaatcgtggtggctcgttgcggctttgccaagtagatagatgcacagctgatatgaaagaggcaaaactgtatcaccggagacacaaagtgtgtgaagttcatgcaaaggcatcttctgtctttctctcaggacttaaccaacgcttttgtcaacaatgcagtaggtttcatgacctccaagagtttgatgaagctaagagaagttgtaggaggcgcttagctggacacaatgagcgaagaaggaagagctctggtgagagtacttatggagaaggatcaggtcggagaggaatcaatggtcaggtggtgatgcagaatcaagaaagatcaagggtagagatgacacttcctatgccaaactcatcattcaagcgaccacagattagatagagaagctgtctgctctctctcttctgtcatctaaacttctctcttagaatcctaaaattgtggtatctaacaatgttatagagaaataaataactaccactctctctagtactctctaatgttatcagctatatgcaaacgctaagactatacttgaaccttgagtgttatcttgtatgtttcaaagatatggctaatgatatgtgtaatacttctacct

SEQ ID NO: 7228 - protein, 174 aa, Arabidopsis thaliana
  misc_feature (1)..(174): useful for making plants with modified plant phenotypes as described in USSN 12/139,269
  misc_feature (53)..(131): Pfam Name: SBP; Pfam Description: SBP domain
  misc_feature (1)..(174): Utility: Useful for making ornamental plants with modified leaves
  misc_feature (1)..(174): Utility: Useful for making smaller plants
  misc_feature (1)..(174): Utility: Useful for making stronger plants
MEGKRSQGQGYMKKKSYLVEEDMETDTDEEEEVGRDRVRGSRGSINRGGSLRLCQVDRCTADMKEAKLYHRRHKVCEVHAKASSVFLSGLNQRFCQQCSRFHDLQEFDEAKRSCRRRLAGHNERRRKSSGESTYGEGSGRRGINGQVVMQNQERSRVEMTLPMPNSSFKRPQIR

SEQ ID NO: 7229 - protein, 138 aa, Glycine max
  misc_feature (1)..(138): useful for making plants with modified plant phenotypes as described in USSN 12/139,269
  misc_feature (1)..(138): Ceres CLONE ID no. 538817
  misc_feature (1)..(138): Utility: Useful for making ornamental plants with modified leaves
  misc_feature (1)..(138): Utility: Useful for making smaller plants
  misc_feature (1)..(138): Utility: Useful for making stronger plants
MDGSWSEGKRSMSYKEEDEYEEEEEEEVSEYGDDGKKKRVVSNKRGSKAGGSVPPSCQVDGCNADLSEAKPYHRRHKVCEYHAKAPAVVIGDQHQRFCQQCSRFHELSEFDDSKRSCRRRLAGHNERRRKNASEYHGL

SEQ ID NO: 7230 - protein, 169 aa, Glycine max
  misc_feature (1)..(169): useful for making plants with modified plant phenotypes as described in USSN 12/139,269
  misc_feature (1)..(169): Public GI no. 55419652
  misc_feature (1)..(169): Utility: Useful for making ornamental plants with modified leaves
  misc_feature (1)..(169): Utility: Useful for making smaller plants
  misc_feature (1)..(169): Utility: Useful for making stronger plants
MQEEEEEGVGGDHGFPDDEKKKKGYGRRGAAGGGGGVSPPACQVEKCGLDLSDAKRYHRRHKVCEIHAKAPFVVVAGLRQRFCQQCSRFHELPEFDEAKRSCRRRLAGHNERRRKSSAESSSAAESSNRRGMMISAQLKESHYLADDQRARVNPMAIHGSSSFKRSQIR

SEQ ID NO: 7231 - protein, 134 aa, Glycine max
  misc_feature (1)..(134): useful for making plants with modified plant phenotypes as described in USSN 12/139,269
  misc_feature (1)..(134): Public GI no. 30577630
  misc_feature (1)..(134): Utility: Useful for making ornamental plants with modified leaves
  misc_feature (1)..(134): Utility: Useful for making smaller plants
  misc_feature (1)..(134): Utility: Useful for making stronger plants
MEASRAEGKRSFMEEEEDQEEEEEEEEKREMSTSSSRRASGSGGSTPPTCQVENCNADLTDAKHYHRRHKVCESHAKAPIVYVAGGQKRFCQQCSRFHDLSEFDEYKKSCRKRLAGHNERRRKSSSDFHREGSN

SEQ ID NO: 7232 - protein, 131 aa, Glycine max
  misc_feature (1)..(131): useful for making plants with modified plant phenotypes as described in USSN 12/139,269
  misc_feature (1)..(131): Public GI no. 1183866
  misc_feature (1)..(131): Utility: Useful for making ornamental plants with modified leaves
  misc_feature (1)..(131): Utility: Useful for making smaller plants
  misc_feature (1)..(131): Utility: Useful for making stronger plants
MDTSKGEGKRVIKLPGSQEQGEEEDDIGEDSKKTRALTPSGKRASGSTQRSCQVENCAAEMTNAKPYHRRHKVCEFHAKAPVVLHSGLQQRFCQQCSRFHELSEFDEAKRSCRRRLAGHNERRRKSSHDTH

SEQ ID NO: 7233 - protein, 175 aa, Glycine max
  misc_feature (1)..(175): useful for making plants with modified plant phenotypes as described in USSN 12/139,269
  misc_feature (1)..(175): Public GI no. 62856979
  misc_feature (1)..(175): Utility: Useful for making ornamental plants with modified leaves
  misc_feature (1)..(175): Utility: Useful for making smaller plants
  misc_feature (1)..(175): Utility: Useful for making stronger plants
MNLGKVDGSCYQKMVKKEAEEDQVSDEELVESGVEEEKKKKGVVGSGGKRCCQAEKCTADLSDGKQYHKRHKVCEHHAKAQVVLVGGMRQRFCQQCSRFHELSEFDETKRSCRRRLAGHNERRRENTAESHAEGSSRKGTGTHQLKDIVCGQVDDRGRIQITIHENSTYKHFQIR

SEQ ID NO: 7234 - DNA, 645 bp, Arabidopsis thaliana
  misc_feature (1)..(645): useful for making plants with modified plant phenotypes as described in USSN 12/139,269
  misc_feature (1)..(645): Ceres CLONE ID no. 13625
  misc_feature (1)..(645): Also known as  Ceres CDNA ID no. 23359269
aaaagacacgtccttttttgcgttactattattctcctcctttctctccaattattctctgagctgtaataacataaacaaaaaaaagattctctcgatcaaacttgccggcgtccatggaagatttcggccgtcaacgaccatacggagacggagggatgcagatccagccttaccacggtaatcaaggcggtgatttcaggagctatagcgcatcgtacgggacgagggagaacaatatatacgatgtgaaaaaggagaaatcgatagcaagatccaagtcttggggaataacggatccggagctccagaggaagaaacgggtcgcgagttataagatgtatggtgttgaaggcaaagtcaaaggctcttttagaaacagtttcagatggcttaagcagaggtacacacaggtcgtctatggttggtggtgattcttttttcatctttttctataatttttacttttttactttgtttttcttcttcttgagctttgttttgaattttgattttctcaagtaattatgattgtgctctctctctctctttcttatgtatctttgtgtttgtgtgttgtaatcttgaatgtaactgtggtggcttcatcgcaacaaaattatatatgatcatttattagtttct

SEQ ID NO: 7235 - protein, 105 aa, Arabidopsis thaliana
  misc_feature (1)..(105): useful for making plants with modified plant phenotypes as described in USSN 12/139,269
  misc_feature (1)..(105): Utility: Useful for making ornamental plants with modified leaves
  misc_feature (1)..(105): Utility: Useful for making plants tolerant to low nitrogen
  misc_feature (1)..(105): Utility: Useful for making plants with altered leaf shape eg curled leaves
  misc_feature (1)..(105): Utility: Useful for making plants with increased biomass and foliage
  misc_feature (1)..(105): Utility: Useful for making smaller plants
  misc_feature (1)..(105): Utility: Useful for making stronger plants
MEDFGRQRPYGDGGMQIQPYHGNQGGDFRSYSASYGTRENNIYDVKKEKSIARSKSWGITDPELQRKKRVASYKMYGVEGKVKGSFRNSFRWLKQRYTQVVYGWW

SEQ ID NO: 7236 - protein, 106 aa, Brassica napus
  misc_feature (1)..(106): useful for making plants with modified plant phenotypes as described in USSN 12/139,269
  misc_feature (1)..(106): Ceres CLONE ID no. 873093
  misc_feature (1)..(106): Utility: Useful for making ornamental plants with modified leaves
  misc_feature (1)..(106): Utility: Useful for making plants tolerant to low nitrogen
  misc_feature (1)..(106): Utility: Useful for making plants with altered leaf shape eg curled leaves
  misc_feature (1)..(106): Utility: Useful for making plants with increased biomass and foliage
  misc_feature (1)..(106): Utility: Useful for making smaller plants
  misc_feature (1)..(106): Utility: Useful for making stronger plants
MEDYNRQRAYGDTGMQIQPYHGGGPGTGDFRSYSTSYATENNIYNIKKEKSIARSKSWGITDPELQRKKRVASYKMYSVEGKVKGSFRKSFRWLKQRYTQVVYGWW

SEQ ID NO: 7237 - protein, 129 aa, Glycine max
  misc_feature (1)..(129): useful for making plants with modified plant phenotypes as described in USSN 12/139,269
  misc_feature (1)..(129): Ceres CLONE ID no. 608685
  misc_feature (1)..(129): Utility: Useful for making ornamental plants with modified leaves
  misc_feature (1)..(129): Utility: Useful for making plants tolerant to low nitrogen
  misc_feature (1)..(129): Utility: Useful for making plants with altered leaf shape eg curled leaves
  misc_feature (1)..(129): Utility: Useful for making plants with increased biomass and foliage
  misc_feature (1)..(129): Utility: Useful for making smaller plants
  misc_feature (1)..(129): Utility: Useful for making stronger plants
MEDFNNYNKSRSHGNNGQMMQQMERYYGGAPPQPTRPYDLRSYSVSSYTQAPNNYNNKDLKMMKKGKSMSSRTSSISKSWSFVTDPEIQRKKRVASYKMYSVEGKVKGSFRKSFRWVKDRYCQVVYGWW

SEQ ID NO: 7238 - protein, 122 aa, Glycine max; identical to SEQ ID NO: 196
  misc_feature (1)..(122): useful for making plants with modified plant phenotypes as described in USSN 12/139,269
  misc_feature (1)..(122): Ceres CLONE ID no. 663726
  misc_feature (1)..(122): Utility: Useful for making ornamental plants with modified leaves
  misc_feature (1)..(122): Utility: Useful for making plants tolerant to low nitrogen
  misc_feature (1)..(122): Utility: Useful for making plants with altered leaf shape eg curled leaves
  misc_feature (1)..(122): Utility: Useful for making plants with increased biomass and foliage
  misc_feature (1)..(122): Utility: Useful for making smaller plants
  misc_feature (1)..(122): Utility: Useful for making stronger plants

SEQ ID NO: 7239 - protein, 158 aa, Glycine max
  misc_feature (1)..(158): useful for making plants with modified plant phenotypes as described in USSN 12/139,269
  misc_feature (1)..(158): Ceres CLONE ID no. 855086
  misc_feature (1)..(158): Utility: Useful for making ornamental plants with modified leaves
  misc_feature (1)..(158): Utility: Useful for making plants tolerant to low nitrogen
  misc_feature (1)..(158): Utility: Useful for making plants with altered leaf shape eg curled leaves
  misc_feature (1)..(158): Utility: Useful for making plants with increased biomass and foliage
  misc_feature (1)..(158): Utility: Useful for making smaller plants
  misc_feature (1)..(158): Utility: Useful for making stronger plants
NIVVSAPHQYQSIKKTRKSSLKNKHGLPLLAANLRLFVPNPTMEEFRSKSYGDGRMQIEAYRGTNMQDLRCYSASYASSVHPTTTQQTQMGNNDAKFKKGKSTNGSTSKSWSFSDPELQRKKRVASYKVYAVEGKLKGSLRKSFKWFKDRCNRVVYGW

SEQ ID NO: 7240 - protein, 117 aa, Glycine max
  misc_feature (1)..(117): useful for making plants with modified plant phenotypes as described in USSN 12/139,269
  misc_feature (1)..(117): Ceres CLONE ID no. 647910
  misc_feature (1)..(117): Utility: Useful for making ornamental plants with modified leaves
  misc_feature (1)..(117): Utility: Useful for making plants tolerant to low nitrogen
  misc_feature (1)..(117): Utility: Useful for making plants with altered leaf shape eg curled leaves
  misc_feature (1)..(117): Utility: Useful for making plants with increased biomass and foliage
  misc_feature (1)..(117): Utility: Useful for making smaller plants
  misc_feature (1)..(117): Utility: Useful for making stronger plants
MEFRSKSCRDARLQIESYCGGKVSPTSMQDLRCYSANNAASSAYAHQIGSKEVKVKKGKTSATKPSKSWSFTDPELQRKKRVAGYKIYAAEGKMKGSLRKSFRWIKNTYTQALYGWW

SEQ ID NO: 7241 - protein, 117 aa, Zea mays; identical to SEQ ID NO: 201
  misc_feature (1)..(117): useful for making plants with modified plant phenotypes as described in USSN 12/139,269
  misc_feature (1)..(117): Ceres CLONE ID no. 1524364
  misc_feature (1)..(117): Utility: Useful for making ornamental plants with modified leaves
  misc_feature (1)..(117): Utility: Useful for making plants tolerant to low nitrogen
  misc_feature (1)..(117): Utility: Useful for making plants with altered leaf shape eg curled leaves
  misc_feature (1)..(117): Utility: Useful for making plants with increased biomass and foliage
  misc_feature (1)..(117): Utility: Useful for making smaller plants
  misc_feature (1)..(117): Utility: Useful for making stronger plants

SEQ ID NO: 7242 - protein, 131 aa, Triticum aestivum
  misc_feature (1)..(131): useful for making plants with modified plant phenotypes as described in USSN 12/139,269
  misc_feature (1)..(131): Ceres CLONE ID no. 686525
  misc_feature (1)..(131): Utility: Useful for making ornamental plants with modified leaves
  misc_feature (1)..(131): Utility: Useful for making plants tolerant to low nitrogen
  misc_feature (1)..(131): Utility: Useful for making plants with altered leaf shape eg curled leaves
  misc_feature (1)..(131): Utility: Useful for making plants with increased biomass and foliage
  misc_feature (1)..(131): Utility: Useful for making smaller plants
  misc_feature (1)..(131): Utility: Useful for making stronger plants
NFPFSSPKRSSTGGFAMAAADYDRAYRPYAPSSAADYDRPYRNEIVPYGDRRIDLVVKPPPPTRSPPPPLPVTKSGGGGGIGSAWCFSDPEVKRRRRVASYKAYSVEGKVKASFRRGFRWIKDKCTGFIHG

SEQ ID NO: 7243 - protein, 163 aa, Zea mays
  misc_feature (1)..(163): useful for making plants with modified plant phenotypes as described in USSN 12/139,269
  misc_feature (1)..(163): Ceres CLONE ID no. 225086
  misc_feature (1)..(163): Utility: Useful for making ornamental plants with modified leaves
  misc_feature (1)..(163): Utility: Useful for making plants tolerant to low nitrogen
  misc_feature (1)..(163): Utility: Useful for making plants with altered leaf shape eg curled leaves
  misc_feature (1)..(163): Utility: Useful for making plants with increased biomass and foliage
  misc_feature (1)..(163): Utility: Useful for making smaller plants
  misc_feature (1)..(163): Utility: Useful for making stronger plants
FLLPLPTKPSLTITSRRVVVVVISLASASTARSPIACWPALLAMDRSKSYAGGRMQIEPYYGGGGGGGGGARADFRSYSYSAGGTGPSSYSYNQYEYGGPGAGEEEVKQSKSKRRWLADPDMDRKRRVAAYKAYGVEGRVKGSLRKSFRWVKDRYLDLVYGWS

SEQ ID NO: 7244 - DNA, 747 bp, Arabidopsis thaliana
  misc_feature (1)..(747): useful for making plants with modified plant phenotypes as described in USSN 12/139,269
  misc_feature (1)..(747): Ceres CLONE ID no. 16865
  misc_feature (1)..(747): Also known as  Ceres CDNA ID no. 23368049
attcgcttccgtttcttaaagcataaaaaccaaaactttctctttcgttttgctttcttccaagcatctgcaggagtgaatcgcaaaaccaaatttggaggattctttctgaggggtttctcagtgagaaaatggcttcgaaacggatcttgaaggagctgaaggatctccagaaagaccctccaacctcctgcagtgcaggtccagttgctgaagacatgtttcattggcaagctacaattatgggtcctgcagagagtccgtattcaggcggtgtgtttctcgttaccattcacttccctccggactatcctttcaagccaccaaaggttgcatttaggacgaaggtgtttcaccctaatatcaacagcaacggaagcatttgccttgacattttgaaagaacaatggagccctgccctcaccatttcgaaggtgttgctttcgatatgttcgctgttaacggatccaaatccagatgacccgttagtgccagagattgcacacatgtacaaaaccgacagagccaagtacaaggctactgctagaaactggactcagaagtatgccatgggctaaacaaagattcgtatgcttcagcacctgtttatgctcttatatctgtttatttctttttcttgttttaactctaataaaaatgtctaaaaatatcaacttttttcgtctgtactatatgtttatggttttattatcatcatctttatctgaaatttgaagatggaattcc

SEQ ID NO: 7245 - protein, 148 aa, Arabidopsis thaliana
  misc_feature (1)..(148): useful for making plants with modified plant phenotypes as described in USSN 12/139,269
  misc_feature (5)..(142): Pfam Name: UQ_con; Pfam Description: Ubiquitin-conjugating enzyme
  misc_feature (1)..(148): Utility: Useful for making ornamental plants with modified leaves
  misc_feature (1)..(148): Utility: Useful for making plants sterile and for genetic confinement
MASKRILKELKDLQKDPPTSCSAGPVAEDMFHWQATIMGPAESPYSGGVFLVTIHFPPDYPFKPPKVAFRTKVFHPNINSNGSICLDILKEQWSPALTISKVLLSICSLLTDPNPDDPLVPEIAHMYKTDRAKYKATARNWTQKYAMG

SEQ ID NO: 7246 - protein, 134 aa, Parthenium argentatum
  misc_feature (1)..(134): useful for making plants with modified plant phenotypes as described in USSN 12/139,269
  misc_feature (1)..(134): Ceres CLONE ID no. 1605695
  misc_feature (1)..(134): Utility: Useful for making ornamental plants with modified leaves
  misc_feature (1)..(134): Utility: Useful for making plants sterile and for genetic confinement
MASKRILKELKDLQKDPPTSCSAGPLAEDMFHWQATIMGPSDSPYSGGVFLVSIHFPPDYPFKPPKVAFRTKVFHPNINSNGSICLDILKEQWSPALTISKVLLSICSLLTDPNPDDPLVPEIAHMYKTDKPKY

SEQ ID NO: 7247 - protein, 148 aa, Zea mays
  misc_feature (1)..(148): useful for making plants with modified plant phenotypes as described in USSN 12/139,269
  misc_feature (1)..(148): Ceres CLONE ID no. 437144
  misc_feature (1)..(148): Utility: Useful for making ornamental plants with modified leaves
  misc_feature (1)..(148): Utility: Useful for making plants sterile and for genetic confinement
MASKRILKELKDLQKDPPTSCSAGPVGEDMFHWQATIMGPSDSPFAGGVFLVNIHFPPDYPFKPPKVSFRTKVFHPNINSNGSICLDILKEQWSPALTISKVLLSICSLLTDPNPDDPLVPEIAHMYKTDRAKYESTARSWTQKYAMG

SEQ ID NO: 7248 - protein, 148 aa, Zea mays
  misc_feature (1)..(148): useful for making plants with modified plant phenotypes as described in USSN 12/139,269
  misc_feature (1)..(148): Ceres CLONE ID no. 1380019
  misc_feature (1)..(148): Utility: Useful for making ornamental plants with modified leaves
  misc_feature (1)..(148): Utility: Useful for making plants sterile and for genetic confinement
  misc_feature (128)..(128): Xaa is any aa, unknown or other
  misc_feature (129)..(129): Xaa is any aa, unknown or other
MASKRILKELKDLHKDPPSSCSAGPVAEDMFHWQATIMGPSDSPYSGGVFLVTIHFPPDYPFKPPKVAFRTKVFHPNVNSNGSICLDILKEQWSPALTISKVLLSICSLLTDPNPDDPLVPEIAHMYXXDRAKYESTARSWTQKYAMG

SEQ ID NO: 7249 - protein, 148 aa, Triticum aestivum
  misc_feature (1)..(148): useful for making plants with modified plant phenotypes as described in USSN 12/139,269
  misc_feature (1)..(148): Ceres CLONE ID no. 1031152
  misc_feature (1)..(148): Utility: Useful for making ornamental plants with modified leaves
  misc_feature (1)..(148): Utility: Useful for making plants sterile and for genetic confinement
MASKRILKELKDLQKDPPTSCSAGPVGEDMFHWQATIMGPSDSPFTGGLFLVNIHFPPDYPFKPPKVSFRTKVFHPNINSNGSICLDILKEQWSPALTISKVLLSICSLLTDPNPDDPLVPEIAHMYKTDRAKYESTARSWTQKYAMG

SEQ ID NO: 7250 - protein, 148 aa, Zea mays; identical to SEQ ID NO: 7249
  misc_feature (1)..(148): useful for making plants with modified plant phenotypes as described in USSN 12/139,269
  misc_feature (1)..(148): Ceres CLONE ID no. 1431307
  misc_feature (1)..(148): Utility: Useful for making ornamental plants with modified leaves
  misc_feature (1)..(148): Utility: Useful for making plants sterile and for genetic confinement

SEQ ID NO: 7251 - protein, 148 aa, Zea mays
  misc_feature (1)..(148): useful for making plants with modified plant phenotypes as described in USSN 12/139,269
  misc_feature (1)..(148): Ceres CLONE ID no. 350577
  misc_feature (1)..(148): Utility: Useful for making ornamental plants with modified leaves
  misc_feature (1)..(148): Utility: Useful for making plants sterile and for genetic confinement
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRPKYEATARSWTQKYAMG

SEQ ID NO: 7252 - protein, 147 aa, Triticum aestivum
  misc_feature (1)..(147): useful for making plants with modified plant phenotypes as described in USSN 12/139,269
  misc_feature (1)..(147): Ceres CLONE ID no. 617835
  misc_feature (1)..(147): Utility: Useful for making ornamental plants with modified leaves
  misc_feature (1)..(147): Utility: Useful for making plants sterile and for genetic confinement
MASKRIQKELKDLQKDPPTSCSAGPVGEDMFHWQATIMGPSDSPYSGGVFLVTIHFPPDYPFKPPKVAFRTKVFHPNINSNGSICLDILKDQWSPALTISKVLLSICSLLYDPNPDDPLVPEIAHMYKTDRHKYESTARTWTQRYAM

SEQ ID NO: 7253 - protein, 148 aa, Zea mays
  misc_feature (1)..(148): useful for making plants with modified plant phenotypes as described in USSN 12/139,269
  misc_feature (1)..(148): Ceres CLONE ID no. 1521928
  misc_feature (1)..(148): Utility: Useful for making ornamental plants with modified leaves
  misc_feature (1)..(148): Utility: Useful for making plants sterile and for genetic confinement
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRPKYESTARSWTQKYAMG

SEQ ID NO: 7254 - protein, 148 aa, Zea mays
  misc_feature (1)..(148): useful for making plants with modified plant phenotypes as described in USSN 12/139,269
  misc_feature (1)..(148): Ceres CLONE ID no. 1437721
  misc_feature (1)..(148): Utility: Useful for making ornamental plants with modified leaves
  misc_feature (1)..(148): Utility: Useful for making plants sterile and for genetic confinement
MASKRILKELKDLQKDPPTSCSAGPSGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRSKYETTARSWTQKYAMG

SEQ ID NO: 7255 - protein, 148 aa, Zea mays
  misc_feature (1)..(148): useful for making plants with modified plant phenotypes as described in USSN 12/139,269
  misc_feature (1)..(148): Ceres CLONE ID no. 702116
  misc_feature (1)..(148): Utility: Useful for making ornamental plants with modified leaves
  misc_feature (1)..(148): Utility: Useful for making plants sterile and for genetic confinement
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDSNPDDPLVPEIAHMYKTDRPKYESTARSWTQKYAMG

SEQ ID NO: 7256 - protein, 148 aa, Zea mays; identical to SEQ ID NO: 7255
  misc_feature (1)..(148): useful for making plants with modified plant phenotypes as described in USSN 12/139,269
  misc_feature (1)..(148): Ceres CLONE ID no. 1591070
  misc_feature (1)..(148): Utility: Useful for making ornamental plants with modified leaves
  misc_feature (1)..(148): Utility: Useful for making plants sterile and for genetic confinement

SEQ ID NO: 7257 - protein, 143 aa, Zea mays
  misc_feature (1)..(143): useful for making plants with modified plant phenotypes as described in USSN 12/139,269
  misc_feature (1)..(143): Ceres CLONE ID no. 256705
  misc_feature (1)..(143): Utility: Useful for making ornamental plants with modified leaves
  misc_feature (1)..(143): Utility: Useful for making plants sterile and for genetic confinement
MAPIFADMAKKSPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRPKYEATARSWTQKYAMG

SEQ ID NO: 7258 - protein, 148 aa, Zea mays
  misc_feature (1)..(148): useful for making plants with modified plant phenotypes as described in USSN 12/139,269
  misc_feature (1)..(148): Ceres CLONE ID no. 1357060
  misc_feature (1)..(148): Utility: Useful for making ornamental plants with modified leaves
  misc_feature (1)..(148): Utility: Useful for making plants sterile and for genetic confinement
MASKRINKELRDLQRDPPVSCSAGPVGDDMFHWQATIMGPTDSPFSGGVFLVSIHFPPDYPFKPPKVSFRTKVYHPNINSNGSICLDILKEQWSPALTISKVLLSICSLLTDPNPDDPLVPEIAHTYKTDRVKYESTARSWTQKYAMG

SEQ ID NO: 7259 - protein, 148 aa, Zea mays
  misc_feature (1)..(148): useful for making plants with modified plant phenotypes as described in USSN 12/139,269
  misc_feature (1)..(148): Ceres CLONE ID no. 1531983
  misc_feature (1)..(148): Utility: Useful for making ornamental plants with modified leaves
  misc_feature (1)..(148): Utility: Useful for making plants sterile and for genetic confinement
MALRRIIKELKDLQRDPPTSCSAGPVSDDMFHWQATIMGPSDSPYSGGVFLVAIHFPPDYPFKPPKVAFKTKVFHPNINSNGSICLDILKEQWSPALTVSKVLLSVCSLLTDPNPDDPLVPEIAHMCKTDRLRYESTARGWTHKYAMG

SEQ ID NO: 7260 - protein, 148 aa, Zea mays
  misc_feature (1)..(148): useful for making plants with modified plant phenotypes as described in USSN 12/139,269
  misc_feature (1)..(148): Ceres CLONE ID no. 376667
  misc_feature (1)..(148): Utility: Useful for making ornamental plants with modified leaves
  misc_feature (1)..(148): Utility: Useful for making plants sterile and for genetic confinement
MANKRIQKELMDLQKDPPTSCSAGPAGEDLFHWQATIMGPSDSPYAGGVFFVNIHFPPDYPFKPPKVNFQTKVYHPNINSNGSICLDILKEQWSPALTISKVLLSISSLLTDPNPDDPLVPEIAHMYKNQRPRYEETARAWTQKYAMG

SEQ ID NO: 7261 - DNA, 836 bp, Arabidopsis thaliana
  misc_feature (1)..(836): useful for making plants with modified plant phenotypes as described in USSN 12/139,269
  misc_feature (1)..(836): Ceres CLONE ID no. 18246
  misc_feature (1)..(836): Also known as  Ceres CDNA ID no. 23366868
acaatcgctggactctgctactgcgaagaacaacaaattccttgtttatcatggcgaattccggcgaagagaagttgaagctctactcttactggagaagctcgtgtgctcatcgtgtccgtatcgccctcgctttgaaagggcttgattatgagtatataccagtgaatttgctcaagggtgatcaattcgattcagatttcaagaagatcaatccaatgggaactgtaccagctctggtggatggagatgttgtgattaatgattcttttgcgataataatgtatctggatgagaagtaccctgagccacctttgttacctcgtgacctccataaacgagctgtgaattaccaggcaatgagtattgtcttgtctggcatacagcctcatcaaaatctggctgttattaggtatatcgaggaaaagataaatgtggaggagaagactgcttgggttaataatgctatcacaaaaggatttacagctctcgagaaactgttggtgaattgcgctgggaaacttgcgactggtgatgaaatttacctggctgatctctttctagcaccacagatccacggagcaatcaacagattccagattaacatggaaccatacccaaatcttgcaaaatgttacgaatcatacaaggaactgcctgtgtttcaaaatgcactaccggaaaagcagccagatgctccttcttccaccaactgattccgtgaacccgtaagctacgctcagcttaataaaacctcagacaacaacaacaatgatgagagtaataccttgtactcgtacatgtatcatataaaccagttacatcttagttcctcc

SEQ ID NO: 7262 - protein, 221 aa, Arabidopsis thaliana
  misc_feature (1)..(221): useful for making plants with modified plant phenotypes as described in USSN 12/139,269
  misc_feature (9)..(82): Pfam Name: GST_N; Pfam Description: Glutathione S-transferase, N-terminal domain
  misc_feature (98)..(203): Pfam Name: GST_C; Pfam Description: Glutathione S-transferase, C-terminal domain
  misc_feature (1)..(221): Utility: Useful for making ornamental plants with modified leaves
  misc_feature (1)..(221): Utility: Useful for making plants sterile and for genetic confinement
  misc_feature (1)..(221): Utility: Useful for making plants with increased biomass and foliage
MANSGEEKLKLYSYWRSSCAHRVRIALALKGLDYEYIPVNLLKGDQFDSDFKKINPMGTVPALVDGDVVINDSFAIIMYLDEKYPEPPLLPRDLHKRAVNYQAMSIVLSGIQPHQNLAVIRYIEEKINVEEKTAWVNNAITKGFTALEKLLVNCAGKLATGDEIYLADLFLAPQIHGAINRFQINMEPYPNLAKCYESYKELPVFQNALPEKQPDAPSSTN

SEQ ID NO: 7263 - protein, 224 aa, Zea mays
  misc_feature (1)..(224): useful for making plants with modified plant phenotypes as described in USSN 12/139,269
  misc_feature (1)..(224): Ceres CLONE ID no. 1376280
  misc_feature (1)..(224): Utility: Useful for making ornamental plants with modified leaves
  misc_feature (1)..(224): Utility: Useful for making plants sterile and for genetic confinement
  misc_feature (1)..(224): Utility: Useful for making plants with increased biomass and foliage
MANLGEEKKGKLKLYSYWRSSCAHRVRIALSLKGLEYEYIPVNLLKGEQSDPDFKKINPMGTVPALVDGDVVISDSLAIIMYLDEKYPEPPLLPPDLHKRAVNFQAASIVLSGIQPHQNLGVIKFIEEKINSEEKTAWVTNAITKGFTALEKLLVSCAGKHATGDEVYLADLFLAPQIYGAINRFQINMEPYPTLAKCYESYKDLPAFQNAAPEKQPDAPASTS

SEQ ID NO: 7264 - protein, 213 aa, Zea mays
  misc_feature (1)..(213): useful for making plants with modified plant phenotypes as described in USSN 12/139,269
  misc_feature (1)..(213): Ceres CLONE ID no. 340652
  misc_feature (1)..(213): Utility: Useful for making ornamental plants with modified leaves
  misc_feature (1)..(213): Utility: Useful for making plants sterile and for genetic confinement
  misc_feature (1)..(213): Utility: Useful for making plants with increased biomass and foliage
MLYSYWRSSCSHRARIALNLKGVDYEYKAVNLLKGEQSDPEFVKLNPMKFVPALVDGSSVIGDSYAITLYLEDKYPEPPLLPQDLQKKALNHQIASIVASGIQPLHNLTVLRFIDQKVGAGESVLWTQQQIERGFTAIENLIQLKGCAGKYATGDEVQLADVFLAPQIYAAIERTKIDMSNYPTLARLHSEYMSHPAFEAALPGKQPDAPSSS

SEQ ID NO: 7265 - protein, 215 aa, Triticum aestivum
  misc_feature (1)..(215): useful for making plants with modified plant phenotypes as described in USSN 12/139,269
  misc_feature (1)..(215): Ceres CLONE ID no. 695982
  misc_feature (1)..(215): Utility: Useful for making ornamental plants with modified leaves
  misc_feature (1)..(215): Utility: Useful for making plants sterile and for genetic confinement
  misc_feature (1)..(215): Utility: Useful for making plants with increased biomass and foliage
MSAATGKPILYSKWFSSCSHRVRIALNLKGVDFEYRATNPMTDPDYEKINPVKFVPAFVDGDFVVSDSFAIILYMEDKYPQCPLLPRDLKKKALNLQIASIVCSSIQPLQSHAVIGSYLGTMDTNESLQMVQHYIDKGFRAIEKLLEGCDSKYATGDEVQMADVFLAPQIHAGVTRFQIDMSKYPILARLQDTYNEHPAFQAALPANQPDAPPSQ

SEQ ID NO: 7266 - protein, 212 aa, Zea mays
  misc_feature (1)..(212): useful for making plants with modified plant phenotypes as described in USSN 12/139,269
  misc_feature (1)..(212): Ceres CLONE ID no. 295402
  misc_feature (1)..(212): Utility: Useful for making ornamental plants with modified leaves
  misc_feature (1)..(212): Utility: Useful for making plants sterile and for genetic confinement
  misc_feature (1)..(212): Utility: Useful for making plants with increased biomass and foliage
MATEKPILYNAWISSCSHRVRIALNLKGVDYEYKSVNPRTDPDYEKINPIKYIPALVDGDIVVSDSLAISLYLEDKYPEHPLLPKDLKRKALNLQIANIVCSSIQPLQGYAVIGLHEGRMSPDEGLHIVQSYIDKGFRAIEKLLEGCESKYATGDDVQLADVFLEPQIHAGINRFQIDMSMYPILERLHDAYMQIPAFQAALPKNQPDAPSS

SEQ ID NO: 7267 - DNA, 1153 bp, Arabidopsis thaliana
  misc_feature (1)..(1153): useful for making plants with modified plant phenotypes as described in USSN 12/139,269
  misc_feature (1)..(1153): Ceres CLONE ID no. 31044
  misc_feature (1)..(1153): Also known as  Ceres CDNA ID no. 23356964
  misc_feature (428)..(428): m is a or c
aaccatctctctaaagcttcttctctcataacaatggcaagacaaatcaacatagagagtagtgtttctcaagttacctttatctcctccgccatccccgccgtatcttcctcctcctccatcaccgcttccgcctcattgtcctcttcacctactacatcttcctcttcttcgtcatcaacaaattctaacttcattgaggaagacaactctaaaagaaaagcatctcgaagatcattgtcatcgttagtctccgttgaagacgatgatgatcaaaacggtggaggtgggaaacggcgaaagaccaacggtggagataaacatccgacgtatagaggagtgaggatgaggagttggggaaaatgggtgtcggagattagagagccgagaaagaaatcaagaatctggctcgggacttatccaacggmtgagatggcagctcgagctcatgacgtagcggctttagccattaaaggtacaacggcttacctcaattttcccaagttagccggcgagcttcctcgtccagtcacaaattctcctaaagacattcaagccgccgcctctttagcggccgttaactggcaagattcggtcaacgatgtgagtaattctgaagtggctgaaatagttgaagccgagccgagtcgaaccgtggtggctcagttgttttcttcggacacaagcacgacgacgacgactcagagtcaagagtattcggaagcttcgtgtgcttcgacttcggcgtgtacggacaaagacagtgaggaagagaagctgtttgatttgccggatttgtttaccgatgagaatgagatgatgatacgaaacgatgcgttttgctactactcgtccacgtggcagctttgtggagccgatgctgggtttcggcttgaagagccgttttttctatctgaatgactaaagtacccctctcgagagagctctcactaacactttattagtttgccatttacttcttcttcattttctctatttacgtttgatatttttttttctttccaacttgagtgatattgattttttgtaaagaaacaatttcttttttttttcctagcaaaatcgtgtttgtgtaatataaatgtggtgataacatgttgaaatattgcagaataatataatgtagccttac

SEQ ID NO: 7268 - protein, 295 aa, Arabidopsis thaliana
  misc_feature (1)..(295): useful for making plants with modified plant phenotypes as described in USSN 12/139,269
  misc_feature (98)..(161): Pfam Name: AP2; Pfam Description: AP2 domain
  misc_feature (98)..(161): Pfam Name: AP2; Pfam Description: AP2 domain
  misc_feature (1)..(295): Utility: Useful for making ornamental plants with modified leaves
  misc_feature (1)..(295): Utility: Useful for making smaller plants
MARQINIESSVSQVTFISSAIPAVSSSSSITASASLSSSPTTSSSSSSSTNSNFIEEDNSKRKASRRSLSSLVSVEDDDDQNGGGGKRRKTNGGDKHPTYRGVRMRSWGKWVSEIREPRKKSRIWLGTYPTAEMAARAHDVAALAIKGTTAYLNFPKLAGELPRPVTNSPKDIQAAASLAAVNWQDSVNDVSNSEVAEIVEAEPSRTVVAQLFSSDTSTTTTTQSQEYSEASCASTSACTDKDSEEEKLFDLPDLFTDENEMMIRNDAFCYYSSTWQLCGADAGFRLEEPFFLSE

SEQ ID NO: 7269 - protein, 263 aa, Triticum aestivum
  misc_feature (1)..(263): useful for making plants with modified plant phenotypes as described in USSN 12/139,269
  misc_feature (1)..(263): Ceres CLONE ID no. 902699
  misc_feature (1)..(263): Utility: Useful for making ornamental plants with modified leaves
  misc_feature (1)..(263): Utility: Useful for making smaller plants
MESDAGENLFGTFSSSTTSITASSSSSPTSSTTTSSNSCTKHDSKISPPQNQNTPNSKKRQRSDDNENKHHPSYRGVRMRAWGKWVSEIREPRKKSRIWLGTYPTAEMAARAHDVAALAVKGHSAFLNFPNLAQDLPRPTTTSPKDIQAAAAKAATTTFFDDEIVNHCQAEKAEQNHGEQQASPSTLCMMDNSTEAEQIQAEQASSTQESSSSHSTADEETLFDLPDLFPDGNSGLFSYSSCWHLCAVDSGFRLEEQFLWENF

SEQ ID NO: 7270 - protein, 274 aa, Glycine max
  misc_feature (1)..(274): useful for making plants with modified plant phenotypes as described in USSN 12/139,269
  misc_feature (1)..(274): Ceres CLONE ID no. 709819
  misc_feature (1)..(274): Utility: Useful for making ornamental plants with modified leaves
  misc_feature (1)..(274): Utility: Useful for making smaller plants
TTIIKVSTMRKRINMESDADFNSFATSSSSTTPSIFFDTNTSSTSSSSTSPTSNSESCTKEHSKTPQNDSTTSQTSLENGKDSKGCKKRQIDNSNQNHHPTYRGVRMRNWGKWVSEIREPRKKSRIWLGTYPTAEMAARAHDVAALAIKGHSAYLNFPELAQELPRPVSTSPKDIQAAAAKAANTAFEEVRHCQITEEEAEQNQAEQASSSTLSMDNPQEPSSSHSTIDDDTLFDLPDLFPDGNNGLCSFSSSWHLCAVDSGFRLEESFFYENH

SEQ ID NO: 7271 - protein, 289 aa, Glycine max
  misc_feature (1)..(289): useful for making plants with modified plant phenotypes as described in USSN 12/139,269
  misc_feature (1)..(289): Public GI no. 37536842
  misc_feature (1)..(289): Utility: Useful for making ornamental plants with modified leaves
  misc_feature (1)..(289): Utility: Useful for making smaller plants
MAMAKELQETSSSSSSSAASTSSCSSAVTDAWSSPARPNAVAGGKRKKEVVGEADEAAGGGAGEEEEEEAEAAAAGKSSAATKKRKRSSDGKHPVYRGVRMRAWGKWVSEIREPRKKSRIWLGTFPTADMAARAHDVAALAIKGRAAHLNFPDLAGVLPRAASASPKDVQAAAALAAAFTTSPSSSPSSSLSADDVAPCVVHADADEQPAAAAKNDDDDGSTTAPVAAAAAAAAADEQQLFDLPDLLFDIQDGPFGFPAMWAPLADVDEVNAELRLEEPLLWDLGVTDA

SEQ ID NO: 7272 - protein, 281 aa, Glycine max
  misc_feature (1)..(281): useful for making plants with modified plant phenotypes as described in USSN 12/139,269
  misc_feature (1)..(281): Public GI no. 21908034
  misc_feature (1)..(281): Utility: Useful for making ornamental plants with modified leaves
  misc_feature (1)..(281): Utility: Useful for making smaller plants
MAQELHETSSCSATTTSSCTTSCCSSTVTDSSSSPPSPAAANAAPATRKRQALEAEAEAEAGGEEEEEEEEGCAGNKAAPAKKRPRGSEGKHPTFRGVRMRAWGKWVSEIREPRKKSRIWLGTFPTAEMAARAHDVAALAIKGRAAHLNFPDLAGALPRAASAAPKDVQAAAALAAAFTSPSSEPGAGAHEEPAAKDGAAPEEAAADAQAPVPVALPPPAASRPGTPSSGVEDERQLFDLPDLLLDIRDGFGRFPPMWAPLTDVEDVVNAELRLEEPLLWE

SEQ ID NO: 7273 - protein, 281 aa, Glycine max
  misc_feature (1)..(281): useful for making plants with modified plant phenotypes as described in USSN 12/139,269
  misc_feature (1)..(281): Public GI no. 25990951
  misc_feature (1)..(281): Utility: Useful for making ornamental plants with modified leaves
  misc_feature (1)..(281): Utility: Useful for making smaller plants
MAQELHETSSCSATTTSSCTTSCCSSTVTDSSSSPPSPAAANAAPATRKRQALEAEAEAEAGGEEEEEEEEGCAGNKAAPAKKRPRGSEGKHPTFRGVRMRAWGKWVSEIREPRKKSRIWLGTFPTAEMAARAHDVAALAIKGRAAHLNFPDLAGALPRAASAAPKDVQAAAALAAAFTSPSSEPGAGAHEEPAAKDGAAPEEAAADAQAPVPVALPPPAASRPGTPSSGVEDERQLFDLPDLLLDIRDGFGRFPPMWAPLTDVEEVVNAELRLEEPLLWE

SEQ ID NO: 7274 - DNA, 1259 bp, Arabidopsis thaliana
  misc_feature (1)..(1259): useful for making plants with modified plant phenotypes as described in USSN 12/139,269
  misc_feature (1)..(1259): Ceres CLONE ID no. 38635
  misc_feature (1)..(1259): Also known as  Ceres CDNA ID no. 24419571
gatcggtcccttttgttttatcgttttagggtttgtagctcctttctctttttttcttttctcaatttcccccaaattaaaaaaaaactctctctttcagagatttacaaatttcatttctccaaatccgaaaccccaaagtgaatatttttccttctgggtttcttttgtttgcctggaaacatttgtctcagattttgattttgaccggagtactcatattctccggcgatttctccggcgacatcgtctgtgaaatggagggaattactcatccaatacctcgtactgttgaagaggtctttagcgacttcagaggtcgacgagctggtcttattaaagctctcactaatgatatggtgaagttttaccaaacgtgtgatcctgagaaggagaatttgtgtctctatggacttccaaatgagacatgggaggttaatctacccgttgaggaagttcctcctgagcttcctgaaccagctttaggcatcaatttcgctagagacggaatgcaagaaaaggactgggtatctttggtcgcagttcacagtgattcatggctgctttctgttgcattttactttggtgcacgtttcggatttggcaagaatgagaggaagaggctgttccagatgattaatgagctgccaaccattttcgaagttgtgagcggcaatgcaaagcagtccaaggatctatctgttaacaacaataatagcaaaagcaaacctagtggcgtcaagtctcgccaatccgaatctctcacaaaggttgcaaagatgtcatctccaccgccaaaagaagaagaagaagaagaagatgagagtgaagatgagagtgaagacgatgaacaaggtgcggtttgtggtgcttgtggagacaactacggtacagatgagttctggatttgctgcgacgcctgtgagaaatggttccatggaaaatgtgtgaagataacacctgcaaaagcagaacacatcaagcattacaaatgcccaacttgcagtaacaagagagccagaccttgaagttaaataaccaaattataagaaggtaaagtgagttaggagaaaattgtgaaagaagaaggtgaagtttccagtttataagaaatgccagtaaaagggactagaagatgtaagcaggtaaaaaatatttgtattgcttaatctttattgttggattgagactatttacagttggtgatgtcttttcttttctttttttttggatttttgttgttgttaatgttaattcta

SEQ ID NO: 7275 - protein, 256 aa, Arabidopsis thaliana
  misc_feature (1)..(256): useful for making plants with modified plant phenotypes as described in USSN 12/139,269
  misc_feature (202)..(252): Pfam Name: PHD; Pfam Description: PHD-finger
  misc_feature (1)..(256): Utility: Useful for making ornamental plants with modified leaves
  misc_feature (1)..(256): Utility: Useful for making plants with altered leaf shape eg curled leaves
MEGITHPIPRTVEEVFSDFRGRRAGLIKALTNDMVKFYQTCDPEKENLCLYGLPNETWEVNLPVEEVPPELPEPALGINFARDGMQEKDWVSLVAVHSDSWLLSVAFYFGARFGFGKNERKRLFQMINELPTIFEVVSGNAKQSKDLSVNNNNSKSKPSGVKSRQSESLTKVAKMSSPPPKEEEEEEDESEDESEDDEQGAVCGACGDNYGTDEFWICCDACEKWFHGKCVKITPAKAEHIKHYKCPTCSNKRARP

SEQ ID NO: 7276 - protein, 244 aa, Zea mays
  misc_feature (1)..(244): useful for making plants with modified plant phenotypes as described in USSN 12/139,269
  misc_feature (1)..(244): Ceres CLONE ID no. 1375513
  misc_feature (1)..(244): Utility: Useful for making ornamental plants with modified leaves
  misc_feature (1)..(244): Utility: Useful for making plants with altered leaf shape eg curled leaves
MEVITHPTPRTVDEVFTDFRGRRAGLIKALTTDMVKFYQTCDPEKENLCLYGLPNETWEVNLPVEEVPPELPEPALGINFARDGMQEKDWVSLVAVHSDSWLLSVAFYFGARFGFGKNERKKLFQMINELPTIFEIVTGNAKQSKDLSGNNNTSSKSKSNGLKVPKMSSPPPKEEDESEDEDEDDEQGAVCGACGDSDGTDEFWICCDACEKWFHGKCVKITPAKAEHIKHYKCPSCSNKRARP

SEQ ID NO: 7277 - protein, 252 aa, Arabidopsis thaliana
  misc_feature (1)..(252): useful for making plants with modified plant phenotypes as described in USSN 12/139,269
  misc_feature (1)..(252): Ceres CLONE ID no. 96978
  misc_feature (1)..(252): Utility: Useful for making ornamental plants with modified leaves
  misc_feature (1)..(252): Utility: Useful for making plants with altered leaf shape eg curled leaves
MEGIQHPIPRTVEEVFSDFRGRRAGLIKALSTDVQKFYHQCDPEKENLCLYGLPNETWEVNLPVEEVPPELPEPALGINFARDGMQEKDWISLVAVHSDSWLISVAFYFGARFGFGKNERKRLFQMINDLPTIFEVVTGNAKQSKDQSANHNSSRSKSSGGKPRHSESHTKASKMSPPPRKEDESGDEDEDDEQGAVCGACGDNYGGDEFWICCDACEKWFHGKCVKITPAKAEHIKHYKCPSCTTSKKMKA

SEQ ID NO: 7278 - protein, 252 aa, Arabidopsis thaliana; identical to SEQ ID NO: 7277
  misc_feature (1)..(252): useful for making plants with modified plant phenotypes as described in USSN 12/139,269
  misc_feature (1)..(252): Public GI no. 30017229
  misc_feature (1)..(252): Utility: Useful for making ornamental plants with modified leaves
  misc_feature (1)..(252): Utility: Useful for making plants with altered leaf shape eg curled leaves

SEQ ID NO: 7279 - protein, 252 aa, Glycine max
  misc_feature (1)..(252): useful for making plants with modified plant phenotypes as described in USSN 12/139,269
  misc_feature (1)..(252): Ceres CLONE ID no. 1242841
  misc_feature (1)..(252): Utility: Useful for making ornamental plants with modified leaves
  misc_feature (1)..(252): Utility: Useful for making plants with altered leaf shape eg curled leaves
MEGVPHPIPRTVEEVFTDFKGRRAGLIKALTTDVEKFYQQCDPEKENLCLYGFPNETWEVNLPVEEVPPELPEPALGINFARDGMQEKDWLSLVAVHSDSWLLAVAFYFGARFGFGKNERKRLFQMINDLPTIFELVTGSAKQSKDQPAAHNNGSKCKSSGKSHQSESQAKGMKMSAPPKEEDESGEEEEEDDEQGATCGACGDNYGTDEFWICCDMCERWFHGKCVKITPAKAEHIKQYKCPSCSNKRVRV

SEQ ID NO: 7280 - protein, 257 aa, Glycine max
  misc_feature (1)..(257): useful for making plants with modified plant phenotypes as described in USSN 12/139,269
  misc_feature (1)..(257): Public GI no. 12651665
  misc_feature (1)..(257): Utility: Useful for making ornamental plants with modified leaves
  misc_feature (1)..(257): Utility: Useful for making plants with altered leaf shape eg curled leaves
MEGMAQHPVPRTVEEVFSDYKGRRAGLIKALTTDVEKFYQLVDPEKENLCLYGFPNETWEVNLPVEEVPPELPEPALGINFARDGMQEKDWLSLVAVHSDSWLLAVAFYFGARFGFGKNDRKRLFQMINDLPTVFELATGTAKQSKDQLTAHNNGSNSKYKSSGKSRQSESQTKGVKMSAPVKEEVDSGEEEEEDDDEQGATCGACGDNYGTDEFWICCDMCEKWFHGKCVKITPAKAEHIKQYKCPGCSIKKPRIG

SEQ ID NO: 7281 - DNA, 1209 bp, Arabidopsis thaliana
  misc_feature (1)..(1209): useful for making plants with modified plant phenotypes as described in USSN 12/139,269
  misc_feature (1)..(1209): Ceres CLONE ID no. 39155
  misc_feature (1)..(1209): Also known as  Ceres CDNA ID no. 23382069
aaattaaaacaaaaaaaacttagaagagaaacaatctcatcgctcagtgactgattcagatgaccagtgtctccgtcgccgtcgtagctcctccgcatcgttgcccattctctagtcatctgaatctgaacaagctttctcttcaaattcctagaaccggctggcggaggaaacagctagggtttgctttagcttctactgcggcttcagaatcaccatcggaagctacatatgatccggagctccgtttagttttcgagctcgctaccgattccgagttatatgagcttgagaaaatcctttttggtcccagctacttcagccctttgctgaaatcaatcccaaacaaaggaggaggtgaccggcttatgataggccaagacattgaagtgcgagatggttttatcgaagctcttgaatcgagattcttgtttctagctgcagatgctcgttcaacactcaggggttggaggccttcatacagaaacgttttacttgcggtgagaaataatttgaatattccctgctccagccaattgccaaccgaagacctagaagcagagatttttctttatcttgtcgacaatttctcgagtgaagcatcaggggtttttccaggcatgtgggaaaattctgaagtctcagaggcagagggaagcttagaactcgggctcagtaaatggaaagttgaactacttgccgcactacaagtgggtgctacagaggtccaatctatgattctgaagggtggtggcatgatcacattcgccaaagtttatcagttgttggctaagaaactatctggaaaagtattccttgaagctgccaactaccagattaggaaagagatgctaaaaaagggtgggcagtttgctgccattaacttggaatctcgagcagctctgttagcagcgaagcatggatttgcaggggctgcatccagatacattggcttaaaaacagcgatgcaattacttggccccatgatgtgggggacattactggctgacttagtgattcagatgctcgagactgactacgctagaatcctaagagcaatttacgcatttgcacagattcggatcaccaggacatacaggctaccttgtaaatgaagtaacagtttgttttctcaatctcagtgtccctacgaactatgtcggtaaacaatgtttttcacactcgtataattcgcttgtggttgaaacc

SEQ ID NO: 7282 - protein, 351 aa, Arabidopsis thaliana
  misc_feature (1)..(351): useful for making plants with modified plant phenotypes as described in USSN 12/139,269
  misc_feature (1)..(351): Utility: Useful for making ornamental plants with modified leaves
  misc_feature (1)..(351): Utility: Useful for making smaller plants
MTSVSVAVVAPPHRCPFSSHLNLNKLSLQIPRTGWRRKQLGFALASTAASESPSEATYDPELRLVFELATDSELYELEKILFGPSYFSPLLKSIPNKGGGDRLMIGQDIEVRDGFIEALESRFLFLAADARSTLRGWRPSYRNVLLAVRNNLNIPCSSQLPTEDLEAEIFLYLVDNFSSEASGVFPGMWENSEVSEAEGSLELGLSKWKVELLAALQVGATEVQSMILKGGGMITFAKVYQLLAKKLSGKVFLEAANYQIRKEMLKKGGQFAAINLESRAALLAAKHGFAGAASRYIGLKTAMQLLGPMMWGTLLADLVIQMLETDYARILRAIYAFAQIRITRTYRLPCK

SEQ ID NO: 7283 - protein, 237 aa, Glycine max
  misc_feature (1)..(237): useful for making plants with modified plant phenotypes as described in USSN 12/139,269
  misc_feature (1)..(237): Ceres CLONE ID no. 676435
  misc_feature (1)..(237): Utility: Useful for making ornamental plants with modified leaves
  misc_feature (1)..(237): Utility: Useful for making smaller plants
  misc_feature (10)..(10): Xaa is any aa, unknown or other
  misc_feature (173)..(173): Xaa is any aa, unknown or other
  misc_feature (215)..(215): Xaa is any aa, unknown or other
  misc_feature (231)..(231): Xaa is any aa, unknown or other
MIGVDLGLRXQFIAALESRFFFLAADARSTLRGWRPSYRNVLLQIRKKLNIPCSTQLSTHDLELEIFLHLLHCNSTEEESSQGQATLQHGLSQWKVQSKVGAQDIPSILLKGGGVFTLSKIYQLLARKLSGKVLVEAANYQVKKELVKKGGQLAMINLESRAAMLAAKQGFLXAASRYLGFRSVVTLLGPVLWGTFLADLVIQMLGTDYARILRXIYALAQIRVIRTYRLXSEVTDE

SEQ ID NO: 7284 - DNA, 742 bp, Arabidopsis thaliana
  misc_feature (1)..(742): useful for making plants with modified plant phenotypes as described in USSN 12/139,269
  misc_feature (1)..(742): Ceres CLONE ID no. 107988
  misc_feature (1)..(742): Also known as  Ceres CDNA ID no. 23389578
atcttgtgatcatcccaagacaaaaccagagaaaaagacctttctgtttttttaagaagtctttatatttttttttttgtcggagaatcttataagcatggcttcaggaggatcaaagtcggcagctttcatgcttctgatgctgaatcttggtctctatttcgtcatcaccatcatcgcttcttgggctgttaatcacggcatagagagaactcgcgagtctgcgtcgacactgtcacttccggcgaagatattcccgatatacttcccggtggggaacatggcgaccggttttttcgtaatattcacgttaatcgccggcgtcgtcggaatggccacatcactcaccggaatcatcaacgttcttcaatgggactctccgaatctccactccgccgcggcttcctctctaatctcctggtctctcactctcctcgccatgggattggcctgcaaggagatcaacataggctggaccgaagccaatctaagaactcttgaagttctgactataattgtgagtgctactcagttgttgtgcaccggagctattcatgctggagtcggagaaacagtcgcctccggagaaaggcctcatcttgggagagtttgagtttcatgattcttcttaaaagcggttttacatttgcttcagatcgtgtaatttgtgtgttgtgtcttgtgtgtgtttattcttttgttttgtttgattattatgatcatgtaaaatgattagtttatg

SEQ ID NO: 7285 - protein, 171 aa, Arabidopsis thaliana
  misc_feature (1)..(171): useful for making plants with modified plant phenotypes as described in USSN 12/139,269
  misc_feature (15)..(156): Pfam Name: AWPM-19; Pfam Description: AWPM-19-like family
  misc_feature (1)..(171): Utility: Useful for making ornamental plants with modified leaves
  misc_feature (1)..(171): Utility: Useful for making plants sterile and for genetic confinement
  misc_feature (1)..(171): Utility: Useful for making plants with altered leaf shape eg curled leaves
MASGGSKSAAFMLLMLNLGLYFVITIIASWAVNHGIERTRESASTLSLPAKIFPIYFPVGNMATGFFVIFTLIAGVVGMATSLTGIINVLQWDSPNLHSAAASSLISWSLTLLAMGLACKEINIGWTEANLRTLEVLTIIVSATQLLCTGAIHAGVGETVASGERPHLGRV

SEQ ID NO: 7286 - protein, 170 aa, Brassica napus
  misc_feature (1)..(170): useful for making plants with modified plant phenotypes as described in USSN 12/139,269
  misc_feature (1)..(170): Ceres CLONE ID no. 948896
  misc_feature (1)..(170): Utility: Useful for making ornamental plants with modified leaves
  misc_feature (1)..(170): Utility: Useful for making plants sterile and for genetic confinement
  misc_feature (1)..(170): Utility: Useful for making plants with altered leaf shape eg curled leaves
MASGGSKSAAFMLLLLNLGLYFVVTIIAAWAVNHGIERARESASVLSLPAKIFPIYFPVGNMATGFFVIFTLIAGVVGMATSLTGIMNVLEWDSPNLHSAAASSLISWSLTLLAMGLACKEINIGWTEANLRTLEVMTIIVSGTQLLCTGAIHVGVGETVDAVRPHVGRA

SEQ ID NO: 7287 - protein, 169 aa, Brassica napus
  misc_feature (1)..(169): useful for making plants with modified plant phenotypes as described in USSN 12/139,269
  misc_feature (1)..(169): Public GI no. 50878365
  misc_feature (1)..(169): Utility: Useful for making ornamental plants with modified leaves
  misc_feature (1)..(169): Utility: Useful for making plants sterile and for genetic confinement
  misc_feature (1)..(169): Utility: Useful for making plants with altered leaf shape eg curled leaves
MATGGPSSMSAGLLFLNLVLYVVVAVIAGWAINYSIDESFNSLQGVSPPVRLFPIYFPIGNLATGFFVIFALLAGVVGVSTSLTGLHDVSQGYPASMMSAAAASIVTWTLTLLAMGLACKEISIGWRPPSLRALETFTIILAGTQLLCAGSLHAGAHVAIIQNPMVSRV

SEQ ID NO: 7288 - protein, 163 aa, Triticum aestivum
  misc_feature (1)..(163): useful for making plants with modified plant phenotypes as described in USSN 12/139,269
  misc_feature (1)..(163): Ceres CLONE ID no. 685420
  misc_feature (1)..(163): Utility: Useful for making ornamental plants with modified leaves
  misc_feature (1)..(163): Utility: Useful for making plants sterile and for genetic confinement
  misc_feature (1)..(163): Utility: Useful for making plants with altered leaf shape eg curled leaves
MASGLLFLNLIMYVVVAVIAGWAVNYSIEDSAHSLRGASPPVRLFPVYFPMGNLATGFFVIFALLAGAVGISTSLTGLRDVTEGYPASMMSAAASALVTWTLTLLAMGLACKEISIGLRPPSLRALETFTIILAGTQLLCVGSLHAGANAAIVQTPMGVRARV

SEQ ID NO: 7289 - protein, 169 aa, Zea mays
  misc_feature (1)..(169): useful for making plants with modified plant phenotypes as described in USSN 12/139,269
  misc_feature (1)..(169): Ceres CLONE ID no. 705978
  misc_feature (1)..(169): Utility: Useful for making ornamental plants with modified leaves
  misc_feature (1)..(169): Utility: Useful for making plants sterile and for genetic confinement
  misc_feature (1)..(169): Utility: Useful for making plants with altered leaf shape eg curled leaves
  misc_feature (105)..(105): Xaa is any aa, unknown or other
MGSALLSLNLIMYVVVAVIAGWAINYSIDESRNSLKGATPPVRLFPIYFPIGNLATGFFVIFALVTGVVGISTSLAGLHEVSQGYPASMMSAAASALVTWTLTVXRHGASVQGDQPQREAREPAHLGGVHHHPDRHAAALRRVAPRRRARGHPGDAYRRQSLAEVRDDS

SEQ ID NO: 7290 - DNA, 987 bp, Arabidopsis thaliana
  misc_feature (1)..(987): useful for making plants with modified plant phenotypes as described in USSN 12/139,269
  misc_feature (1)..(987): Ceres CLONE ID no. 109912
  misc_feature (1)..(987): Also known as  Ceres CDNA ID no. 23362001
ataactaacctcccctctctctctctctttctctctgctttcttggtatggctgctgacgtcagctctctcgtacggatactgagtaggttcaaggatgatcggacggttgtaaaagattccaccggaccaagatccacggtggcgctcatgacacgcgatctcctcggaatcggcggttgtgtgggtggaggaggaggaggagacgaacagtcgctggagcttgaccttgacgtccaagtccctaacggatgggaaaaacgtctcgacttaaagtcagggaaagtgtatctgcaacaacaatgcaattcaacgagctcgtcatcatcgtctcatcatcatcatcatcatcacgaagaccaaaccaaccaaacagttccaagatttcaagatttgaatgtgccaccgatttccgataagtttccggcgaaaccattgttaagcctcttcgacgatgacgacgacacaagccttgaactgaagctagttccgtcttctatctctcgtcctcttcctcctcctctgtcttctttttctccaaatcagtctctctcgtatctatcgagtgtttgcacactagataaggtgaaattggctttggaaagggcggagaaagatacaaagaaacgccaatctcctgaagatgacggcgtttacgatggaaccgcttctgccaccgtcgcggcgtctcaggtggcggctggatgtccagggtgtttatcgtacgtgtttgtggcaaagaacaatccgaaatgcccgaggtgtcattcgtttgttcctttgcctgccatgaagaagcctaagattgatcttaacatttcgatgtgaaaaaaactttgggggatagaattgaatggttttattttgtaggttcgatttctgtaaatgatagataaaatcagggggtttcattgaaaagaaattaaatgcagaaaggaagagatggatgttattttgtaaattgttatgtaatggattttctttgatg

SEQ ID NO: 7291 - protein, 259 aa, Arabidopsis thaliana
  misc_feature (1)..(259): useful for making plants with modified plant phenotypes as described in USSN 12/139,269
  misc_feature (1)..(259): Utility: Useful for making ornamental plants with modified leaves
  misc_feature (1)..(259): Utility: Useful for making plants with altered leaf shape eg curled leaves
  misc_feature (1)..(259): Utility: Useful for making plants with increased biomass and foliage
MAADVSSLVRILSRFKDDRTVVKDSTGPRSTVALMTRDLLGIGGCVGGGGGGDEQSLELDLDVQVPNGWEKRLDLKSGKVYLQQQCNSTSSSSSSHHHHHHHEDQTNQTVPRFQDLNVPPISDKFPAKPLLSLFDDDDDTSLELKLVPSSISRPLPPPLSSFSPNQSLSYLSSVCTLDKVKLALERAEKDTKKRQSPEDDGVYDGTASATVAASQVAAGCPGCLSYVFVAKNNPKCPRCHSFVPLPAMKKPKIDLNISM

SEQ ID NO: 7292 - protein, 245 aa, Brassica napus
  misc_feature (1)..(245): useful for making plants with modified plant phenotypes as described in USSN 12/139,269
  misc_feature (1)..(245): Ceres CLONE ID no. 966236
  misc_feature (1)..(245): Utility: Useful for making ornamental plants with modified leaves
  misc_feature (1)..(245): Utility: Useful for making plants with altered leaf shape eg curled leaves
  misc_feature (1)..(245): Utility: Useful for making plants with increased biomass and foliage
  misc_feature (188)..(188): Xaa is any aa, unknown or other
  misc_feature (198)..(198): Xaa is any aa, unknown or other
  misc_feature (200)..(200): Xaa is any aa, unknown or other
  misc_feature (201)..(201): Xaa is any aa, unknown or other
  misc_feature (202)..(202): Xaa is any aa, unknown or other
  misc_feature (225)..(225): Xaa is any aa, unknown or other
  misc_feature (243)..(243): Xaa is any aa, unknown or other
MTADVSSLVRLLSRYNDDRTTVKDSARQGSSVALMTRDLLGSGSCRGGGGGDQSLELDLDLKVPNGWEKRLDLKSGKVYLQQQNSTTSSHHRRAEQSNQTFRKFQDLNFPSKSPVRPLLSLFDDTSLELKLVTSSSSSPASSSSSSLCVSSTSSSFQSVCTLDKVKSALERAGRVSSGTLKKRKSPEXEDVCDQTASXAXXXPVAVGCPGCLSYVLVMKNDPKCXRCHSFVALPAVKRPKIDXNI

SEQ ID NO: 7293 - DNA, 1160 bp, Arabidopsis thaliana
  misc_feature (1)..(1160): useful for making plants with modified plant phenotypes as described in USSN 12/139,269
  misc_feature (1)..(1160): Ceres CLONE ID no. 154718
  misc_feature (1)..(1160): Also known as  Ceres CDNA ID no. 23376572
atcttttcttacaaagactttttgacatctccccctccagctattatatagtctccttttttcttttctgcattcacataatattgcccctatatagtttacacaacatcatacccaccaacatatataatcttgatcatagagagataaacagaggccgctatcaagaacaagactaagaacaagacttcactaggagtacaagtatgggaagagcaccgtgttgtgacaaagcaaacgtgaagaaagggccttggtctcctgaggaagatgcaaaactcaaatcttacattgaaaatagtggcaccggaggcaattggatcgctttgcctcaaaagattggtttaaagagatgtggaaagagttgcaggctgaggtggcttaactatcttagaccaaacatcaaacacggtggcttctctgaggaagaagaaaacatcatttgtagcctttaccttacaattggtagcaggtggtctataatcgctgctcaattgccgggacgaacagacaacgatataaaaaactattggaacacgaggctcaagaagaaactcattaacaaacaacgcaaggagcttcaagaagcttgtatggagcagcaagagatgatggtgatgatgaagagacaacaccaacaacaacaaatccaaacttcttttatgatgagacaagaccaaacaatgttcacatggccactacatcatcataatgttcaagttccagctcttttcatgaatcaaaccaactcgttttgcgaccaagaagatgttaagccagtgctcatcaagaacatggtcaagatcgaagatcaagaactggagaaaacaaaccctcatcatcatcaagattcaatgacaaacgcttttgatcatctctctttctctcaactcttgttagatcctaatcataaccacttaggatcaggagagggtttctccatgaactctatcttgagcgccaacacaaactctccattgcttaacacaagtaatgataatcagtggttcgggaatttccaggccgaaaccgtaaacttgttctcaggagcctccacaagtacttcggcagatcaaagcactataagttgggaagacataagctctcttgtttattctgattcaaagcaatttttttaattataataatatattattctt

SEQ ID NO: 7294 - protein, 310 aa, Arabidopsis thaliana
  misc_feature (1)..(310): useful for making plants with modified plant phenotypes as described in USSN 12/139,269
  misc_feature (14)..(62): Pfam Name: Myb_DNA-binding; Pfam Description: Myb-like DNA-binding domain
  misc_feature (14)..(62): Pfam Name: Myb_DNA-binding; Pfam Description: Myb-like DNA-binding domain
  misc_feature (1)..(310): Utility: Useful for making ornamental plants with modified leaves
  misc_feature (1)..(310): Utility: Useful for making plants sterile and for genetic confinement
  misc_feature (1)..(310): Utility: Useful for making plants with increased biomass and foliage
  misc_feature (1)..(310): Utility: Useful for making smaller plants
MGRAPCCDKANVKKGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKKKLINKQRKELQEACMEQQEMMVMMKRQHQQQQIQTSFMMRQDQTMFTWPLHHHNVQVPALFMNQTNSFCDQEDVKPVLIKNMVKIEDQELEKTNPHHHQDSMTNAFDHLSFSQLLLDPNHNHLGSGEGFSMNSILSANTNSPLLNTSNDNQWFGNFQAETVNLFSGASTSTSADQSTISWEDISSLVYSDSKQFF

SEQ ID NO: 7295 - protein, 309 aa, Arabidopsis thaliana
  misc_feature (1)..(309): useful for making plants with modified plant phenotypes as described in USSN 12/139,269
  misc_feature (1)..(309): Public GI no. 2832408
  misc_feature (1)..(309): Utility: Useful for making ornamental plants with modified leaves
  misc_feature (1)..(309): Utility: Useful for making plants sterile and for genetic confinement
  misc_feature (1)..(309): Utility: Useful for making plants with increased biomass and foliage
  misc_feature (1)..(309): Utility: Useful for making smaller plants
MGRAPCCDKANVKKGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKKKLINKQRKELQEACMEQQEMMVMMKRQHQQQQIQTSFMMRQDQTMFTWPLHHHNVQVPALFRIKPTRFATKKMLSQCSSRTWSRSKIKNWRKQTSSSSRFNDNAFDHLSFSQLLLDPNHNHLGSGEGFSMNSILSANTNSPLLNTSNDNQWFGNFQAETVNLFSGASTSTSADQSTISWEDISSLVYSDSKQFF

SEQ ID NO: 7296 - protein, 321 aa, Arabidopsis thaliana
  misc_feature (1)..(321): useful for making plants with modified plant phenotypes as described in USSN 12/139,269
  misc_feature (1)..(321): Public GI no. 50872446
  misc_feature (1)..(321): Utility: Useful for making ornamental plants with modified leaves
  misc_feature (1)..(321): Utility: Useful for making plants sterile and for genetic confinement
  misc_feature (1)..(321): Utility: Useful for making plants with increased biomass and foliage
  misc_feature (1)..(321): Utility: Useful for making smaller plants
MGRAPCCDKASVKKGPWSPEEDAKLKSYIEQNGTGGNWIALPQKIGLKRCGKSCRLRWLNYLRPNIKHGGFSEEEDRIILSLYISIGSRWSIIAAQLPGRTDNDIKNYWNTRLKKKLFGKQSRKDQRQQQHLARQAAAAASDLQIKQEASRGANEADGLAAGANYTWHHHHAMAVPVHPMSAPMVVEGGRVGDDVDESIRKLLFKLGGNPFAASPAPPCIPPPPMYEEAPSFVPPLAHGVPLNEGGMQCSSVLPALELDENFHFNHVKLDGLECLFGMGDHQNMRWNEVSPLVCPNNAVASSSQGMQQYCLVEEPADLGMQ

SEQ ID NO: 7297 - DNA, 1085 bp, Zea mays
  misc_feature (1)..(1085): useful for making plants with modified plant phenotypes as described in USSN 12/139,269
  misc_feature (1)..(1085): Ceres CLONE ID no. 226122
  misc_feature (1)..(1085): Also known as  Ceres CDNA ID no. 23747788
  misc_feature (590)..(590): d is a or g or t/u
aactctctctctctctctctctatctgtctgcccgtggcgtgctccactgattcttcttcttcttctacctcccggcctcctcccccttcttctttgcctgccttattagtatctcgcctcacaccacacagctagcagacagccagacacgcgctgctttctgatctctccccggatcggaggctcctcccaacataccaccctgccagccgcgccgccacgtccacgccggccggccaccaagcaagcatggatatggtttcgcagtccgagcacctgtgctacgtccgctgcacctactgcaacaccgtgctcgcggttggggttccatgcaagaggctgatggacacggtgactgtcaagtgcggccactgcaacaacctctcctacctcagtccacggccccccatggtgcagccgctctcgccgactgatcaccctttggggccattccagtgtcagggaccctgcaacgactgcaggaggaaccaaccgctgccgctggcttcgccgtcatcaactgagctaagcccgagaatgcccttcgtagtcaagcccccggagaagaaacaccgcctcccatctgctdataatcgcttcatgagggaggagattcagcgcatcaaagctgcgaagccagatatccctcacagggaggccttcagcatggctgccaagaattgggcaaagtgtgacccgcgctgctcgacggctgcctctaccgaaacttctaacagcgctcctgctgagcctagagttgtgcccactccccagttaactgagccacgctttgacctggaggatagggccaaggggcaagtcattgagagcttcgacatcttcaagcatattgagcgcagcatctagaggtcgttcgatgccgctgttgtagcccagtatcgatcgagtaccatcagctatatgtataacctatcccgtatcgccgtcgtcgcctcgcaatcatgcatccccatcctgtacttttacccccgtacgtgttactgttgctgttattctcgttatggttggattgtacgcaccatttaattatgaacagctgctacctatatatataatatttgcc

SEQ ID NO: 7298 - protein, 205 aa, Zea mays
  misc_feature (1)..(205): useful for making plants with modified plant phenotypes as described in USSN 12/139,269
  misc_feature (1)..(156): Pfam Name: YABBY; Pfam Description: YABBY protein
  misc_feature (1)..(205): Utility: Useful for making ornamental plants with modified leaves
  misc_feature (1)..(205): Utility: Useful for making plants sterile and for genetic confinement
  misc_feature (1)..(205): Utility: Useful for making plants with increased biomass and foliage
  misc_feature (1)..(205): Utility: Useful for modifying fruit shape, composition and seed yield
MDMVSQSEHLCYVRCTYCNTVLAVGVPCKRLMDTVTVKCGHCNNLSYLSPRPPMVQPLSPTDHPLGPFQCQGPCNDCRRNQPLPLASPSSTELSPRMPFVVKPPEKKHRLPSAYNRFMREEIQRIKAAKPDIPHREAFSMAAKNWAKCDPRCSTAASTETSNSAPAEPRVVPTPQLTEPRFDLEDRAKGQVIESFDIFKHIERSI

SEQ ID NO: 7299 - protein, 152 aa, Zea mays
  misc_feature (1)..(152): useful for making plants with modified plant phenotypes as described in USSN 12/139,269
  misc_feature (1)..(152): Ceres CLONE ID no. 425913
  misc_feature (1)..(152): Utility: Useful for making ornamental plants with modified leaves
  misc_feature (1)..(152): Utility: Useful for making plants sterile and for genetic confinement
  misc_feature (1)..(152): Utility: Useful for making plants with increased biomass and foliage
  misc_feature (1)..(152): Utility: Useful for modifying fruit shape, composition and seed yield
MVQPLSPTDHPLGPFQCQGPCSECRRNQPLPLASPTSTDLTPRMPFVVKPPEKKHRLPSAYNRFMREEIQRIKAAKPDIPHREAFSMAAKNWAKCDPRCSTTASTATSNSAPEAARVVPTPHVTEPRFDLEDRAKEHVIESFDIFKQIERTI

SEQ ID NO: 7300 - protein, 112 aa, Triticum aestivum
  misc_feature (1)..(112): useful for making plants with modified plant phenotypes as described in USSN 12/139,269
  misc_feature (1)..(112): Ceres CLONE ID no. 888225
  misc_feature (1)..(112): Utility: Useful for making ornamental plants with modified leaves
  misc_feature (1)..(112): Utility: Useful for making plants sterile and for genetic confinement
  misc_feature (1)..(112): Utility: Useful for making plants with increased biomass and foliage
  misc_feature (1)..(112): Utility: Useful for modifying fruit shape, composition and seed yield
  misc_feature (104)..(104): Xaa is any aa, unknown or other
MDLVSPSEHLCYVRCTYCNTVLALQVGVPCKRLMDTVTVKCGHCNNLSFLSPRPPPMVQPLSPNDHHHPMGPFQGWTDCRRNQPLPPLASPTSSDASPRAPFVXKPPEKKHR

SEQ ID NO: 7301 - protein, 194 aa, Triticum aestivum
  misc_feature (1)..(194): useful for making plants with modified plant phenotypes as described in USSN 12/139,269
  misc_feature (1)..(194): Public GI no. 40645413
  misc_feature (1)..(194): Utility: Useful for making ornamental plants with modified leaves
  misc_feature (1)..(194): Utility: Useful for making plants sterile and for genetic confinement
  misc_feature (1)..(194): Utility: Useful for making plants with increased biomass and foliage
  misc_feature (1)..(194): Utility: Useful for modifying fruit shape, composition and seed yield
MDLVSPSEHLCYVRCTYCNTVLAVGVPCKRLMDTVTVKCGHCNNLSFLSPRPPMVQPLSPTDHPLGPFQGPCTDCRRNQPLPLVSPTSNEGSPRAPFVVKPPEKKHRLPSAYNRFMREEIQRIKAAKPDIPHREAFSMAAKNWAKCDPRCSSTVSTSNSNPEPRVVAAPIPHQERANEQVVESFDIFKQMERSG

SEQ ID NO: 7302 - protein, 166 aa, Triticum aestivum
  misc_feature (1)..(166): useful for making plants with modified plant phenotypes as described in USSN 12/139,269
  misc_feature (1)..(166): Public GI no. 58891213
  misc_feature (1)..(166): Utility: Useful for making ornamental plants with modified leaves
  misc_feature (1)..(166): Utility: Useful for making plants sterile and for genetic confinement
  misc_feature (1)..(166): Utility: Useful for making plants with increased biomass and foliage
  misc_feature (1)..(166): Utility: Useful for modifying fruit shape, composition and seed yield
VPQSEHLCYVRCNFCNTVLAVGIPCKRLLETVTVKCGHCSNLSFLSTRPPLQGQCLDPQTSLTLQSFCGDFRKGTQFPSPSSSTSSEPSSPKAPFVVKPPEKKHRLPSAYNRFMKEEIQRIKAANPEIPHREAFSAAAKNWARYIPNSPAASSVCGSSSNEQNDNV

SEQ ID NO: 7303 - protein, 170 aa, Triticum aestivum
  misc_feature (1)..(170): useful for making plants with modified plant phenotypes as described in USSN 12/139,269
  misc_feature (1)..(170): Public GI no. 58891235
  misc_feature (1)..(170): Utility: Useful for making ornamental plants with modified leaves
  misc_feature (1)..(170): Utility: Useful for making plants sterile and for genetic confinement
  misc_feature (1)..(170): Utility: Useful for making plants with increased biomass and foliage
  misc_feature (1)..(170): Utility: Useful for modifying fruit shape, composition and seed yield
VPQSEHLCYVRCNFCNTVLAVGIPCKRLLETVTVKCGHCSNLSFLSTRPPLQGQCLDPQTSLTLQSFCGDFRKGTQFPSPSSSTSSEPSSPKAPFVVKPPEKKHRLPSAYNRFMKEEIQRIKAANPEIPHREAFSAAAKNWARYIPNSPAASSVCGSSSNGFYENFAGTK

SEQ ID NO: 7304 - protein, 165 aa, Triticum aestivum
  misc_feature (1)..(165): useful for making plants with modified plant phenotypes as described in USSN 12/139,269
  misc_feature (1)..(165): Public GI no. 41745674
  misc_feature (1)..(165): Utility: Useful for making ornamental plants with modified leaves
  misc_feature (1)..(165): Utility: Useful for making plants sterile and for genetic confinement
  misc_feature (1)..(165): Utility: Useful for making plants with increased biomass and foliage
  misc_feature (1)..(165): Utility: Useful for modifying fruit shape, composition and seed yield
MDMANQSSSEHLCYVRCNFCSTVLAVGIPCKRLMDTVTVKCGHCSNLSFLSTRPPIQGQYYDHQTSLHHQSLCSEFKKGGSSSFSSSTSSEPLSPKAPFVVKPPEKKHRLPSAYNRFMKEEIQRIKAANPEIPHREAFSAAAKNWARYIPNTPPPVPVTTSNHNI

SEQ ID NO: 7305 - protein, 165 aa, Glycine max
  misc_feature (1)..(165): useful for making plants with modified plant phenotypes as described in USSN 12/139,269
  misc_feature (1)..(165): Ceres CLONE ID no. 545652
  misc_feature (1)..(165): Utility: Useful for making ornamental plants with modified leaves
  misc_feature (1)..(165): Utility: Useful for making plants sterile and for genetic confinement
  misc_feature (1)..(165): Utility: Useful for making plants with increased biomass and foliage
  misc_feature (1)..(165): Utility: Useful for modifying fruit shape, composition and seed yield
MDLVPPSEHLCYVRCNFCNTVLAVGIPCKRLLDTVTVKCGHCSNLSFLSTRPPSSQSQSVDHTLSLQGFYSNAKKGQASSSSSSPTTSNESVSPKAASFVVKPPEKKHRLPSAYNRFMKEEIQRIKAANPEIPHREAFSAAAKNWARFIPNSPTSSVSATKVNAD

SEQ ID NO: 7306 - protein, 162 aa, Glycine max
  misc_feature (1)..(162): useful for making plants with modified plant phenotypes as described in USSN 12/139,269
  misc_feature (1)..(162): Public GI no. 58891129
  misc_feature (1)..(162): Utility: Useful for making ornamental plants with modified leaves
  misc_feature (1)..(162): Utility: Useful for making plants sterile and for genetic confinement
  misc_feature (1)..(162): Utility: Useful for making plants with increased biomass and foliage
  misc_feature (1)..(162): Utility: Useful for modifying fruit shape, composition and seed yield
MDLAQTSEHLCYVRCSFCNTVLAVGIPFKRLLDTVTVKCGHCSNLSFLSTRPPLQGQCFDHQTALQHQAFFSDYKKGQSSSSFSSSSSEPSSPKAPFVVKPPEKKHRLPSAYNRFMKEEIQRIKAANPEIPHREAFSAAAKNWARYIPNTPNGPLSESRNNA

SEQ ID NO: 7307 - protein, 186 aa, Glycine max
  misc_feature (1)..(186): useful for making plants with modified plant phenotypes as described in USSN 12/139,269
  misc_feature (1)..(186): Public GI no. 58891059
  misc_feature (1)..(186): Utility: Useful for making ornamental plants with modified leaves
  misc_feature (1)..(186): Utility: Useful for making plants sterile and for genetic confinement
  misc_feature (1)..(186): Utility: Useful for making plants with increased biomass and foliage
  misc_feature (1)..(186): Utility: Useful for modifying fruit shape, composition and seed yield
MNLEEKSVMDSQAPTQSEHLCYVRCNFCNTVLAVGIPCKRMLDTVTVKCGHCSNLSFLSVRPPLHGQCLDHQVNLTLQTQSFCGNELKKGSSSSSSSSSTSSDQPSSPKAPFVVKPPEKKHRLPSAYNRFMKEEIQRIKAANPEIPHREAFSAAAKNWARYIPNSPPGSISAGSSSINGFDFGEMK

SEQ ID NO: 7308 - protein, 196 aa, Glycine max
  misc_feature (1)..(196): useful for making plants with modified plant phenotypes as described in USSN 12/139,269
  misc_feature (1)..(196): Public GI no. 60649824
  misc_feature (1)..(196): Utility: Useful for making ornamental plants with modified leaves
  misc_feature (1)..(196): Utility: Useful for making plants sterile and for genetic confinement
  misc_feature (1)..(196): Utility: Useful for making plants with increased biomass and foliage
  misc_feature (1)..(196): Utility: Useful for modifying fruit shape, composition and seed yield
MDFLPGSTDHLCYVRCNFCDTLLAVGVPCRRLMDTVTVKCGHCSHLSFLSARPLLQNQSLELLSTQNFCGDNKKSQQSSSSSPLTPNQQVVPKVPNVVKPPEKKHRLPSAYNRFMKEEIKRIKAGNPEIPHREAFSMAAKNWARFDPQLLHGSTTSTQIEKQVKPNQEIHEMVTAGGRVKQEDMRQLQAAARSQIT

SEQ ID NO: 7309 - protein, 174 aa, Glycine max
  misc_feature (1)..(174): useful for making plants with modified plant phenotypes as described in USSN 12/139,269
  misc_feature (1)..(174): Public GI no. 58891028
  misc_feature (1)..(174): Utility: Useful for making ornamental plants with modified leaves
  misc_feature (1)..(174): Utility: Useful for making plants sterile and for genetic confinement
  misc_feature (1)..(174): Utility: Useful for making plants with increased biomass and foliage
  misc_feature (1)..(174): Utility: Useful for modifying fruit shape, composition and seed yield
MDLIPSPEHLCYVRCNFCSTVLAVGIPCKRTLDTVTVKCGHCGNISFLSTRPPIQGQCLDHQVDAFQSFRNEYRKGQSSSSSSSTSCGQPTSPNEPNYVVKPPERKHRLPSAYNRYMKEEIQRIKSANPEIPHREAFSSAAKNWAKYVPHSQAGTVSGGKKNERVPAKESLDGA

SEQ ID NO: 7310 - protein, 173 aa, Arabidopsis thaliana
  misc_feature (1)..(173): useful for making plants with modified plant phenotypes as described in USSN 12/139,269
  misc_feature (1)..(173): Ceres CLONE ID no. 9132
  misc_feature (1)..(173): Utility: Useful for making ornamental plants with modified leaves
  misc_feature (1)..(173): Utility: Useful for making plants sterile and for genetic confinement
  misc_feature (1)..(173): Utility: Useful for making plants with increased biomass and foliage
  misc_feature (1)..(173): Utility: Useful for modifying fruit shape, composition and seed yield
MTASRASPQAEHLYYVRCSICNTILAVGIPLKRMLDTVTVKCGHCGNLSFLTTTPPLQGHVSLTLQMQSFGGSDYKKGSSSSSSSSTSSDQPPSPSPPFVVKPPEKKQRLPSAYNRFMRDEIQRIKSANPEIPHREAFSAAAKNWATYIPNSPTSITSGGHNMIHGLGFGEKK

SEQ ID NO: 7311 - protein, 164 aa, Brassica napus
  misc_feature (1)..(164): useful for making plants with modified plant phenotypes as described in USSN 12/139,269
  misc_feature (1)..(164): Ceres CLONE ID no. 953501
  misc_feature (1)..(164): Utility: Useful for making ornamental plants with modified leaves
  misc_feature (1)..(164): Utility: Useful for making plants sterile and for genetic confinement
  misc_feature (1)..(164): Utility: Useful for making plants with increased biomass and foliage
  misc_feature (1)..(164): Utility: Useful for modifying fruit shape, composition and seed yield
MANSPTAAEQLCYIPCNFCNIVLAVSVPCSSLFDIVTVRCGHCTNLWSVNMAAALQSLSRPNFQVTPYATPEYGSSSRGHTKISSRISARTISEQRIVNRPPEKRQRVPSAYNQFIKEEIQRIKANNPDISHREAFSTAAKNWAHFPHIHFGLMLESNKQAKLA

SEQ ID NO: 7312 - DNA, 1681 bp, Glycine max; identical to SEQ ID NO: 5255
  misc_feature (1)..(1681): useful for making plants with modified plant phenotypes as described in USSN 12/139,269
  misc_feature (1)..(1681): Ceres CLONE ID no. 691319
  misc_feature (1)..(1681): Also known as  Ceres CDNA ID no. 23404488

SEQ ID NO: 7313 - protein, 453 aa, Glycine max; identical to SEQ ID NO: 5256
  misc_feature (1)..(453): useful for making plants with modified plant phenotypes as described in USSN 12/139,269
  misc_feature (209)..(272): Pfam Name: AP2; Pfam Description: AP2 domain
  misc_feature (1)..(453): Utility: Useful for making ornamental plants with modified leaves
  misc_feature (1)..(453): Utility: Useful for making plants with increased biomass
  misc_feature (1)..(453): Utility: Useful for making plants with increased biomass and foliage
  misc_feature (1)..(453): Utility: Useful for making smaller plants

SEQ ID NO: 7314 - protein, 331 aa, Zea mays
  misc_feature (1)..(331): useful for making plants with modified plant phenotypes as described in USSN 12/139,269
  misc_feature (1)..(331): Ceres CLONE ID no. 1475648
  misc_feature (1)..(331): Utility: Useful for making ornamental plants with modified leaves
  misc_feature (1)..(331): Utility: Useful for making plants with increased biomass
  misc_feature (1)..(331): Utility: Useful for making plants with increased biomass and foliage
  misc_feature (1)..(331): Utility: Useful for making smaller plants
MCCAPKVANAEGRGPCRCCAGGEEDDEDGQQPAAAWRMLSGYERSREASMMVDALATVVAGGATPPATAGARQQQVSPEGQWWSDYYAGDVTPPPSLPAPAAHEHGAARIPATAASPSSSSQAPSPSSTGSGTPRRRYRGVRQRPWGKWAAEIRDPHKAARVWLGNFDTAEAAARAYDVAALRFRGSRAKLNFPESATLAAPPPTAAAAAVPPPPSPPPQRPEALLESQALALAGGREYSEYARFLQCPADPPRLYDQAPAATVPSAASGSASSSFPVLFRFGGGGESSGAASSQWWTQGSRSVSQEGAGSPPASWADSAWWPAPPRDPPR

SEQ ID NO: 7315 - protein, 391 aa, Zea mays
  misc_feature (1)..(391): useful for making plants with modified plant phenotypes as described in USSN 12/139,269
  misc_feature (1)..(391): Public GI no. 30725634
  misc_feature (1)..(391): Utility: Useful for making ornamental plants with modified leaves
  misc_feature (1)..(391): Utility: Useful for making plants with increased biomass
  misc_feature (1)..(391): Utility: Useful for making plants with increased biomass and foliage
  misc_feature (1)..(391): Utility: Useful for making smaller plants
MCVLKVANQEDNVGKKAESIRDDDHRTLSEIDQWLYLFAAEDDHHRHSFPTQQPPPSSSSSSLISGFSREMEMSAIVSALTHVVAGNVPQHQQGGGEGSGEGTSNSSSSSGQKRRREVEEGGAKAVKAANTLTVDQYFSGGSSTSKVREASSNMSGPGPTYEYTTTATASSETSSFSGDQPRRRYRGVRQRPWGKWAAEIRDPFKAARVWLGTFDNAESAARAYDEAALRFRGNKAKLNFPENVKLVRPASTEAQPVHQTAAQRPTQSRNSGSTTTLLPIRPASNQSVHSQPLMQSYNLSYSEMARQQQQFQQHHQQSLDLYDQMSFPLRFGHTGGSMMQSTSSSSSHSRPLFSPAAVQPPPESASETGYLQDIQWPSDKTSNNYNNSPSS

SEQ ID NO: 7316 - DNA, 458 bp, Arabidopsis thaliana
  misc_feature (1)..(458): useful for making plants with modified plant phenotypes as described in USSN 12/139,269
  misc_feature (1)..(458): Ceres CLONE ID no. 256148
  misc_feature (1)..(458): Also known as  Ceres CDNA ID no. 23365263
atcaaagcttgtgcaggataagatgagccccacactgtggatgtatagtgaagactctgtaaggtgaatgaacataggaaggtgaaagctcgaaggagaatctctgaagaatcaaagccagagccatctttgcttccaacagagcgaagttctgaccgatgcaaatcctcggtccccacccgaaaggcaagaagcagacctggttctttgttgcctttgcgatcccttctttgaacctctcgggcttgaactccgctgcatcatcgccccaaagcttagtgtcacggtggattagcagaacaggcatatggacttgaatacagcctggtagtgtcatatcacctagctttatctctttgtgagtcgctctgttcatctggattactggaggatatagcctcaggacttcatatataatcattgtcatctgtaggaacaaaatcatcaaaacaaaattg

SEQ ID NO: 7317 - protein, 52 aa, Arabidopsis thaliana
  misc_feature (1)..(52): useful for making plants with modified plant phenotypes as described in USSN 12/139,269
  misc_feature (1)..(52): Utility: Useful for making ornamental plants with modified leaves
  misc_feature (1)..(52): Utility: Useful for making plants sterile and for genetic confinement
  misc_feature (1)..(52): Utility: Useful for making plants with altered leaf shape eg curled leaves
  misc_feature (1)..(52): Utility: Useful for making plants with increased biomass and foliage
MQILGPHPKGKKQTWFFVAFAIPSLNLSGLNSAASSPQSLVSRWISRTGIWT

SEQ ID NO: 7318 - DNA, 1270 bp, Arabidopsis thaliana
  misc_feature (1)..(1270): useful for making plants with modified plant phenotypes as described in USSN 12/139,269
  misc_feature (1)..(1270): Ceres CLONE ID no. 641
  misc_feature (1)..(1270): Also known as  Ceres CDNA ID no. 23389172
acttgccaaaaacctcactcttaaccattaacaatgtcgtctccggcgactactatcaccttctttttcttcttcactctctcatccttcttctacatcacttcttcactccagaacaacaacaacaacaacaacaaacacacagcaaccgttaactccttaaatatcccctccgccgcggcggagattacgctagtaaacccaaagcttccgccgcggagtctctccctcacatcctccaaaaaattcgaaggatcttcaaatctagtccacctccgttaccacatgggaccagtcctctcatcttctccgatcaacatctacgttatctggtacggacaatggtcacgcccacacaaatccctaatcagagatttcctcaattctatctccgacgctaaagcaccttctccctccgtatccgaatggtggcgcaccgcttctctctacacagatcaaaccggatccaacgtctctagatccgttttaatcgccggagaatactccgattctaaatactcccacggccaacaccttactcgtctcacgattcaggaagtcatcgcctccgccgccagatccgcttcctttccggtggatcataaaaacggaatgtatctagttctgacgtcacacgacgtcacgatgcaagatttttgccgcgccgtttgtggatttcactatttcactttcccgtcgatggttggttacactatgccttacgcttgggttggtcaatcgggaaaacaatgtcccgaggtttgtgcttatccgtttgctttaccgggttacatgggacacggtggtcccggagagctccggccaccgaacggagagactggagtagatgggatggttagtgtgattggtcatgagttagctgaagttgtatcgaatccgttgattaatgcttggtacgccggagaagatccgacggctccgacggagatcggtgatttgtgtgagggattgtacggaagcggcggaggaggagggtatattggtcaagttatgagagatagagaagggaagacttttaatatgaatggtaaaggaggaagaaagtttttagttcaatggatttggaaccctaatttgaaagcttgctctggtcctaactctgtcgactaataaaacgaagaagaaggttaatgatggtgatttgtggtaatcactgagataatgatgaaataactcgttaggttttagaagtgtaacattattttacttatgatttcttatatatataaagttttaaagaatgcttttc

SEQ ID NO: 7319 - protein, 365 aa, Arabidopsis thaliana
  misc_feature (1)..(365): useful for making plants with modified plant phenotypes as described in USSN 12/139,269
  misc_feature (81)..(362): Pfam Name: Phi_1; Pfam Description: Phosphate-induced protein 1 conserved region
  misc_feature (1)..(365): Utility: Useful for making plants sterile and for genetic confinement
  misc_feature (220)..(220): Xaa is any aa, unknown or other
MSSPATTITFFFFFTLSSFFYITSSLQNNNNNNNKHTATVNSLNIPSAAAEITLVNPKLPPRSLSLTSSKKFEGSSNLVHLRYHMGPVLSSSPINIYVIWYGQWSRPHKSLIRDFLNSISDAKAPSPSVSEWWRTASLYTDQTGSNVSRSVLIAGEYSDSKYSHGQHLTRLTIQEVIASAARSASFPVDHKNGMYLVLTSHDVTMQDFCRAVCGFHYFTXPSMVGYTMPYAWVGQSGKQCPEVCAYPFALPGYMGHGGPGELRPPNGETGVDGMVSVIGHELAEVVSNPLINAWYAGEDPTAPTEIGDLCEGLYGSGGGGGYIGQVMRDREGKTFNMNGKGGRKFLVQWIWNPNLKACSGPNSVD

SEQ ID NO: 7320 - protein, 281 aa, Glycine max
  misc_feature (1)..(281): useful for making plants with modified plant phenotypes as described in USSN 12/139,269
  misc_feature (1)..(281): Ceres CLONE ID no. 620977
  misc_feature (1)..(281): Utility: Useful for making plants sterile and for genetic confinement
MGPVLSSPINIYLIWYGKWPQSQKLLIKDFLNSISDHRAAPSPSVSDWWRTVSLYTDQTGANISRSVSIAGEYSDLRYSHGTHLTRLSVQEVIATAVQAKPFPVDHRNGIYLILTAEDVTMEDFCRAVCGFHYFTFPSKVGYTLPYAWVGNSGKQCPEVCAYPFAVPGYMGGGGPGHLTPPNGDVGVDGMVSVIGHELAELSSNPLVNAWYAGEDPTAPTEIGDLCEGLYGTGGGGGYIGSVMKDGEGRTFNLNGRNGRKFLVQWIWSPVLKACAGPNALD

SEQ ID NO: 7321 - protein, 340 aa, Zea mays
  misc_feature (1)..(340): useful for making plants with modified plant phenotypes as described in USSN 12/139,269
  misc_feature (1)..(340): Ceres CLONE ID no. 338717
  misc_feature (1)..(340): Utility: Useful for making plants sterile and for genetic confinement
MQHLAAVLLVLAATTALPPGAAAWRPWPPRDNATAAAGLGASKRLEGSSEFVKLEYHMGPVLASAITVHPIWYGPWPAAQKRTIRAFLRSLSPSAAIPSPSVSAWWRTVRLYPDQTSANVSASVSLGAEKSDARMSRGARLSRMDIQAVVRDAVTARTRPLPVDASGGVYLVLTSPDVAVDDFCGQVCGFHYFTFASVVGSTLPYAWVGNSARRCPEVCAYPFAVPAYVRGRRPESPPNGDVGVDGMVSVIAHELAEMASNPLANAWYAGGDPSFPTEIADLCEGIYGTGGGGAYTGQLLTDARSGAAYNVNGVGGRRFLVQWVWNPVLSYCSGPNALDQ

SEQ ID NO: 7322 - protein, 331 aa, Triticum aestivum
  misc_feature (1)..(331): useful for making plants with modified plant phenotypes as described in USSN 12/139,269
  misc_feature (1)..(331): Ceres CLONE ID no. 697370
  misc_feature (1)..(331): Utility: Useful for making plants sterile and for genetic confinement
MGTLLPCHPTLTLLPLLFAAAIVGVRCAPVYRPEYLVDGNQLVNMQYHMGPVVSGAPTNLFLIWYGRWEAPAQAVLRDFLASLSAPAPFPAVSDWWARTPRLYTDQSGANVTATFAIAGEHSDAGYSHGASLKRIDMQSIIRTAVVAYPDPLPLDPYNGVYLVLSSPDVQVEEFCRAMCGFHYFTFASVVGVTVPYAWVGNSGSQCPGRCAYPFAAPEYGASGQGVLRPPNGDPGVDGMVIVLGHELAELATNPLVNAWYAGDTPTAPTEIADLCLGVYGDGGGAGGFVGNVSHAADGSSYNVNGVNGRRFLVQWLWNPVLGACYGPNSSN

SEQ ID NO: 7323 - DNA, 1486 bp, Arabidopsis thaliana
  misc_feature (1)..(1486): useful for making plants with modified plant phenotypes as described in USSN 12/139,269
  misc_feature (1)..(1486): Ceres CLONE ID no. 3819
  misc_feature (1)..(1486): Also known as  Ceres CDNA ID no. 23458679
gaattgtctcgttgtcctcctcactttcatcagccgttttgaatctccggcgacttgacagagaagaacaaggaagaagactaagagagaaagtaagagataatccaggagattcattctccgttttgaatcttcctcaatctcatcttcttccgctctttctttccaagctcataaaaaatggctgaggctgatgatattcaaccaatcgtgtgtgacaatggtaccggtatggtgaaggctggatttgcaggagatgatgctcccagggctgtttttcccagtgttgttggtaggccaagacatcatggtgtcatggttgggatgaaccagaaggatgcatatgttggtgatgaagcacaatccaagagaggtattcttaccttgaagtatcctattgagcatggtgttgttagcaactgggatgatatggaaaagatctggcatcacactttctacaatgagcttcgtattgctcctgaagagcaccctgttcttcttaccgaggctcctcttaacccaaaggccaacagagagaagatgactcaaatcatgtttgagacctttaactctcccgctatgtatgtcgccatccaagctgttctctccttgtacgccagtggtcgtacaaccggtattgtgctggattctggtgatggtgtgtctcacactgtgccaatctacgagggtttctctcttcctcatgccatcctccgtcttgaccttgctggacgtgaccttactgattacctcatgaagatccttacagagagaggttacatgttcaccacaacagcagagcgggaaattgtaagagacatcaaggagaagctctcctttgttgctgttgactacgagcaggagatggaaacctcaaagaccagctcttccatcgagaagaactatgaattacccgatgggcaagtcatcacgattggtgctgagagattcagatgcccagaagtcttgttccagccctcgtttgtgggaatggaagctgctggaatccacgagacaacctataactcaatcatgaagtgtgatgtggatatcaggaaggatctgtacggtaacattgtgctcagtggtggaaccactatgttctcaggtatcgctgaccgtatgagcaaagaaatcacagcacttgcaccaagcagcatgaagattaaggtcgttgcaccacctgaaaggaagtacagtgtctggatcggtggttccattcttgcttccctcagcacattccagcagatgtggatctccaaggccgagtatgatgaggcaggtccaggaatcgttcacagaaaatgtttctaagctctcaagatcaaaggcttaaaaagctggggttttatgaatgggatcaaagtttctttttttcttttatatttgcttctccatttgtttgtttcatttccctttttgttttcgtttctatgatgcacttgtgtgtgacaaactctctgggtttttacttacgtctgcgttt

SEQ ID NO: 7324 - protein, 377 aa, Arabidopsis thaliana
  misc_feature (1)..(377): useful for making plants with modified plant phenotypes as described in USSN 12/139,269
  misc_feature (8)..(377): Pfam Name: Actin; Pfam Description: Actin
  misc_feature (1)..(377): Utility: Useful for making plants sterile and for genetic confinement
  misc_feature (1)..(377): Utility: Useful for making smaller plants
MAEADDIQPIVCDNGTGMVKAGFAGDDAPRAVFPSVVGRPRHHGVMVGMNQKDAYVGDEAQSKRGILTLKYPIEHGVVSNWDDMEKIWHHTFYNELRIAPEEHPVLLTEAPLNPKANREKMTQIMFETFNSPAMYVAIQAVLSLYASGRTTGIVLDSGDGVSHTVPIYEGFSLPHAILRLDLAGRDLTDYLMKILTERGYMFTTTAEREIVRDIKEKLSFVAVDYEQEMETSKTSSSIEKNYELPDGQVITIGAERFRCPEVLFQPSFVGMEAAGIHETTYNSIMKCDVDIRKDLYGNIVLSGGTTMFSGIADRMSKEITALAPSSMKIKVVAPPERKYSVWIGGSILASLSTFQQMWISKAEYDEAGPGIVHRKCF

SEQ ID NO: 7325 - protein, 360 aa, Zea mays; identical to SEQ ID NO: 5773
  misc_feature (1)..(360): useful for making plants with modified plant phenotypes as described in USSN 12/139,269
  misc_feature (1)..(360): Ceres CLONE ID no. 338602
  misc_feature (1)..(360): Utility: Useful for making plants sterile and for genetic confinement
  misc_feature (1)..(360): Utility: Useful for making smaller plants

SEQ ID NO: 7326 - protein, 360 aa, Zea mays; identical to SEQ ID NO: 5773
  misc_feature (1)..(360): useful for making plants with modified plant phenotypes as described in USSN 12/139,269
  misc_feature (1)..(360): Ceres CLONE ID no. 299306
  misc_feature (1)..(360): Utility: Useful for making plants sterile and for genetic confinement
  misc_feature (1)..(360): Utility: Useful for making smaller plants

SEQ ID NO: 7327 - protein, 360 aa, Arabidopsis thaliana
  misc_feature (1)..(360): useful for making plants with modified plant phenotypes as described in USSN 12/139,269
  misc_feature (1)..(360): Ceres CLONE ID no. 122726
  misc_feature (1)..(360): Utility: Useful for making plants sterile and for genetic confinement
  misc_feature (1)..(360): Utility: Useful for making smaller plants
MVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDIKEKLAYVALDYEQELETAKSSSSVEKNYELPDGQVITIGAERFRCPEVLFQPSLIGMEAPGIHETTYNSIMKCDVDIRKDLYGNIVLSGGSTMFPGIADRMSKEITALAPSSMKIKVVAPPERKYSVWIGGSILASLSTFQQMWISKSEYDESGPSIVHRKCF

SEQ ID NO: 7328 - protein, 360 aa, Zea mays; identical to SEQ ID NO: 5777
  misc_feature (1)..(360): useful for making plants with modified plant phenotypes as described in USSN 12/139,269
  misc_feature (1)..(360): Ceres CLONE ID no. 292789
  misc_feature (1)..(360): Utility: Useful for making plants sterile and for genetic confinement
  misc_feature (1)..(360): Utility: Useful for making smaller plants

SEQ ID NO: 7329 - protein, 360 aa, Brassica napus; identical to SEQ ID NO: 5779
  misc_feature (1)..(360): useful for making plants with modified plant phenotypes as described in USSN 12/139,269
  misc_feature (1)..(360): Ceres CLONE ID no. 1073372
  misc_feature (1)..(360): Utility: Useful for making plants sterile and for genetic confinement
  misc_feature (1)..(360): Utility: Useful for making smaller plants

SEQ ID NO: 7330 - protein, 360 aa, Zea mays; identical to SEQ ID NO: 5777
  misc_feature (1)..(360): useful for making plants with modified plant phenotypes as described in USSN 12/139,269
  misc_feature (1)..(360): Ceres CLONE ID no. 327971
  misc_feature (1)..(360): Utility: Useful for making plants sterile and for genetic confinement
  misc_feature (1)..(360): Utility: Useful for making smaller plants

SEQ ID NO: 7331 - protein, 360 aa, Zea mays
  misc_feature (1)..(360): useful for making plants with modified plant phenotypes as described in USSN 12/139,269
  misc_feature (1)..(360): Ceres CLONE ID no. 227487
  misc_feature (1)..(360): Utility: Useful for making plants sterile and for genetic confinement
  misc_feature (1)..(360): Utility: Useful for making smaller plants
MVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYDQELENAKSSSSVEKSYELPDGQVITIGAERFRCPEVLFQPSFIGMEAPGIHETTYNSIMKCDVDIRKDLYGNIVLSGGTTMFPGIADRMSKEITALAPSSMKIKVVAPPERKYSVWIGGSILASLSTFQQMWISKAEYDESGPAIVHRKCF

SEQ ID NO: 7332 - protein, 360 aa, Zea mays; identical to SEQ ID NO: 5778
  misc_feature (1)..(360): useful for making plants with modified plant phenotypes as described in USSN 12/139,269
  misc_feature (1)..(360): Ceres CLONE ID no. 996136
  misc_feature (1)..(360): Utility: Useful for making plants sterile and for genetic confinement
  misc_feature (1)..(360): Utility: Useful for making smaller plants

SEQ ID NO: 7333 - protein, 360 aa, Arabidopsis thaliana; identical to SEQ ID NO: 5776
  misc_feature (1)..(360): useful for making plants with modified plant phenotypes as described in USSN 12/139,269
  misc_feature (1)..(360): Ceres CLONE ID no. 116045
  misc_feature (1)..(360): Utility: Useful for making plants sterile and for genetic confinement
  misc_feature (1)..(360): Utility: Useful for making smaller plants

SEQ ID NO: 7334 - protein, 360 aa, Zea mays; identical to SEQ ID NO: 5774
  misc_feature (1)..(360): useful for making plants with modified plant phenotypes as described in USSN 12/139,269
  misc_feature (1)..(360): Ceres CLONE ID no. 331439
  misc_feature (1)..(360): Utility: Useful for making plants sterile and for genetic confinement
  misc_feature (1)..(360): Utility: Useful for making smaller plants

SEQ ID NO: 7335 - protein, 360 aa, Zea mays; identical to SEQ ID NO: 5774
  misc_feature (1)..(360): useful for making plants with modified plant phenotypes as described in USSN 12/139,269
  misc_feature (1)..(360): Ceres CLONE ID no. 230603
  misc_feature (1)..(360): Utility: Useful for making plants sterile and for genetic confinement
  misc_feature (1)..(360): Utility: Useful for making smaller plants

SEQ ID NO: 7336 - protein, 360 aa, Zea mays; identical to SEQ ID NO: 5774
  misc_feature (1)..(360): useful for making plants with modified plant phenotypes as described in USSN 12/139,269
  misc_feature (1)..(360): Ceres CLONE ID no. 219282
  misc_feature (1)..(360): Utility: Useful for making plants sterile and for genetic confinement
  misc_feature (1)..(360): Utility: Useful for making smaller plants

SEQ ID NO: 7337 - protein, 360 aa, Arabidopsis thaliana; identical to SEQ ID NO: 5776
  misc_feature (1)..(360): useful for making plants with modified plant phenotypes as described in USSN 12/139,269
  misc_feature (1)..(360): Ceres CLONE ID no. 25785
  misc_feature (1)..(360): Utility: Useful for making plants sterile and for genetic confinement
  misc_feature (1)..(360): Utility: Useful for making smaller plants

SEQ ID NO: 7338 - protein, 360 aa, Arabidopsis thaliana; identical to SEQ ID NO: 5780
  misc_feature (1)..(360): useful for making plants with modified plant phenotypes as described in USSN 12/139,269
  misc_feature (1)..(360): Ceres CLONE ID no. 41421
  misc_feature (1)..(360): Utility: Useful for making plants sterile and for genetic confinement
  misc_feature (1)..(360): Utility: Useful for making smaller plants

SEQ ID NO: 7339 - protein, 377 aa, Zea mays; identical to SEQ ID NO: 5775
  misc_feature (1)..(377): useful for making plants with modified plant phenotypes as described in USSN 12/139,269
  misc_feature (1)..(377): Ceres CLONE ID no. 294922
  misc_feature (1)..(377): Utility: Useful for making plants sterile and for genetic confinement
  misc_feature (1)..(377): Utility: Useful for making smaller plants

SEQ ID NO: 7340 - protein, 360 aa, Zea mays; identical to SEQ ID NO: 5781
  misc_feature (1)..(360): useful for making plants with modified plant phenotypes as described in USSN 12/139,269
  misc_feature (1)..(360): Ceres CLONE ID no. 1549130
  misc_feature (1)..(360): Utility: Useful for making plants sterile and for genetic confinement
  misc_feature (1)..(360): Utility: Useful for making smaller plants

SEQ ID NO: 7341 - protein, 360 aa, Zea mays; identical to SEQ ID NO: 5783
  misc_feature (1)..(360): useful for making plants with modified plant phenotypes as described in USSN 12/139,269
  misc_feature (1)..(360): Ceres CLONE ID no. 223048
  misc_feature (1)..(360): Utility: Useful for making plants sterile and for genetic confinement
  misc_feature (1)..(360): Utility: Useful for making smaller plants

SEQ ID NO: 7342 - DNA, 1111 bp, Arabidopsis thaliana
  misc_feature (1)..(1111): useful for making plants with modified plant phenotypes as described in USSN 12/139,269
  misc_feature (1)..(1111): Ceres CLONE ID no. 3853
  misc_feature (1)..(1111): Also known as  Ceres CDNA ID no. 23618114
acttcctttcacgatccaaaacaaaacacaagaaaatgcaacaaaatcttctccatctctgaactcaaaaactcattcactgagaaaaatggagacccttctctcccctcgtgcgctctctcctcctctcaatcccaaacctttgtcccttcaccagaccaaacccacttcacattcattgtctctctcaaaacccaccaccttctccggtcctaaacacctctccacccggttcactaaaccggaatcaagaaactggttaatagatgcaaagcaaggactagctgctttagctttatctctaactctcactttctcacctgttggcactgctttagcctctgagttcaatatcctcaacgatggtccacctaaagaaacttacgtagtcgatgacgctggtgttcttagtcgagtgacgaagtcagatcttaagaagcttttgtctgatcttgaatacagaaagaaactgagactcaatttcatcactgtccgaaagctcaccagtaaagcagatgcgtttgagtatgcagaccaggttttggaaaaatggtatccttctattgaagaaggtaacaataagggtattgttgttttgataacaagtcagaaggaaggagctattactggtggtcctgcttttattgaagctgttggtgaaaacattcttgatgctaccgtctccgaaaatcttcccgtactagcaacggacgaaaaatacaacgaggcggtatatagcagtgcgaaaaggttggttgcagctatagacggtcaaccagatcccgggggtccaaccgtaaaggatagcaagagagaatcaaatttcaagacgaaagaagaaaccgatgagaagcgaggacagttcagtcttgtcgttggaggattacttgtaattgcctttgtagttcccatggcacaatactttgcttatgtctccaggaagtaagtaagtaaactcggttcactctcgtaaaccaaaccgatcaggtcagaactttgatttacctcggttatttggttatggtttcttggtaaattggtttatttgaacaatataagtaaataataacagaaaactaaagaatgaatgaaaccatccgattgtaacggc

SEQ ID NO: 7343 - protein, 285 aa, Arabidopsis thaliana
  misc_feature (1)..(285): useful for making plants with modified plant phenotypes as described in USSN 12/139,269
  misc_feature (105)..(229): Pfam Name: DUF477; Pfam Description: Domain of unknown function (DUF477)
  misc_feature (105)..(229): Pfam Name: DUF477; Pfam Description: Domain of unknown function (DUF477)
  misc_feature (1)..(285): Utility: Useful for making plants sterile and for genetic confinement
METLLSPRALSPPLNPKPLSLHQTKPTSHSLSLSKPTTFSGPKHLSTRFTKPESRNWLIDAKQGLAALALSLTLTFSPVGTALASEFNILNDGPPKETYVVDDAGVLSRVTKSDLKKLLSDLEYRKKLRLNFITVRKLTSKADAFEYADQVLEKWYPSIEEGNNKGIVVLITSQKEGAITGGPAFIEAVGENILDATVSENLPVLATDEKYNEAVYSSAKRLVAAIDGQPDPGGPTVKDSKRESNFKTKEETDEKRGQFSLVVGGLLVIAFVVPMAQYFAYVSRK

SEQ ID NO: 7344 - protein, 293 aa, Glycine max
  misc_feature (1)..(293): useful for making plants with modified plant phenotypes as described in USSN 12/139,269
  misc_feature (1)..(293): Ceres CLONE ID no. 478120
  misc_feature (1)..(293): Utility: Useful for making plants sterile and for genetic confinement
MGTIFPPHSLSPLLNIKPSPSRILLAPCPQPKSNSLFCSKPIVSSLRKNQTSSPKPSSGTSWLAHAQQGLAALAISLALNFSPVLFNGNALASEFDVLNEGPPKDSYVFDDAGVLSRVTRSDLKQLLSDLESRKNFRINFITVRKLTSKADAFEYADQVLERWYPSVEEGNNKGIVVLVTSQKEGAVTGGPAFVEAVGEKILDATVSENLPVLATDEKYNEAIFSTAKRLAAAIDGLPDPGGPTVKDNKRESNFKTKEETEEKRGQFTLVVGGLLVIAFVVPMAQYYAYVSKK

SEQ ID NO: 7345 - protein, 290 aa, Zea mays
  misc_feature (1)..(290): useful for making plants with modified plant phenotypes as described in USSN 12/139,269
  misc_feature (1)..(290): Ceres CLONE ID no. 375711
  misc_feature (1)..(290): Utility: Useful for making plants sterile and for genetic confinement
METLLSPSTLFTLPLRGSSRRPSLAASVSSRPTVSCSSALKRPQAGAVAASSHGDGVGRNWMSFLHHGLAAAALSLAIGLTPAPAPAVASEFDVLNDGAPVDSYVVDDAGVLSRVTKSDVKRLARDLEARKNIRLNFITVRKLTSKADAFEYADQVLEKWYPTIEEGNNKGIVVLVTSQKEGAVTGGPAFIQAVGDQILDATVSENLPVLATDEKYNEAILSTAKRLAAAIDGLPDTGGPSFKENKRESNFKTKEETEEKRGQFTLVVGGLLVIAVVVPMAQYYAYVSKK

SEQ ID NO: 7346 - protein, 299 aa, Zea mays
  misc_feature (1)..(299): useful for making plants with modified plant phenotypes as described in USSN 12/139,269
  misc_feature (1)..(299): Public GI no. 50878369
  misc_feature (1)..(299): Utility: Useful for making plants sterile and for genetic confinement
METLLSPSTLLSPLRGSKKKPASPAASASSSSSSPARSVVSCALRRQQPPPQAVAAWRGDGGRGGGVGSWATFLQHGLAAAALSLAISMAPAPAPAVASEFDVLNGGPPEDTYVVDDAGVLSRVTKSDVKRLVRDLESRKNIRINFITVRKLTSKADAFEYADQVLEKWYPTVEEGNNKGIVVLVTSQKEGAITGGPAFVQAVGDEILDSTVSENLPVLATDEKYNEAIYTTAKRLAAAIDGLPDPGGPTFKDNKRESNFKTKEETEEKRGQFTLVVGGLLVIAFVVPMAQYYAYISKK

SEQ ID NO: 7347 - DNA, 853 bp, Arabidopsis thaliana
  misc_feature (1)..(853): useful for making plants with modified plant phenotypes as described in USSN 12/139,269
  misc_feature (1)..(853): Ceres CLONE ID no. 8133
  misc_feature (1)..(853): Also known as  Ceres CDNA ID no. 23388875
cacgggagattttttcttcttctccacttttcgccaccatttcttctccttctctttctctctctctatctaaattcggtggaaggtccaacctcagactatgaccggcggagactggattcacgaggctatgggtgatgattcattagtggcggaggctctgatctgtctcctccatgccgagccgtcacttcctgacacgaagagcggcggcgcgtcggatctcaagctgaagtggagcgtgcgtcagcggaggaccaaggcggcgacgttaaggaagaagggagatcatgatacgcgtgctagtcccacgaccccactttcatggagcggcgcaacctcttttagcggcggtggaggcggtgctgctgctgccgttgatggatttgaggagtcaagtggcgttgtgaaactgtctgaggccgttagatctaagataactcaaacgagtgttacaacaagccctttcaagagatcaagaaagaaaaagacacttgctcaacttaaagaggaggagagtgtgctcttaaaggaaaggaatggcttgagaaatgaactcgcaactatgcaggatctgctcaagcaacaaagagcaagaaatgagtctttaaagaaactccaggctgagtcacaaaagaatgatgattcctccttcttgctccctgaccttaatatagctctggataacaactcgagccctgaaagtctctatggaaccagctgatatataactacgacacaattttcacatcaatattcttttgtcagtgacacgttctctagactacgcgtaactatgtaactatacgatttggataagaatttatagataggtaatagtcgtcccctttcc

SEQ ID NO: 7348 - protein, 207 aa, Arabidopsis thaliana
  misc_feature (1)..(207): useful for making plants with modified plant phenotypes as described in USSN 12/139,269
  misc_feature (1)..(207): Utility: Useful for making plants sterile and for genetic confinement
  misc_feature (1)..(207): Utility: Useful for making plants with altered leaf shape eg curled leaves
  misc_feature (1)..(207): Utility: Useful for making smaller plants
  misc_feature (1)..(207): Utility: Useful for modifying plant structure, ie increased branching
MTGGDWIHEAMGDDSLVAEALICLLHAEPSLPDTKSGGASDLKLKWSVRQRRTKAATLRKKGDHDTRASPTTPLSWSGATSFSGGGGGAAAAVDGFEESSGVVKLSEAVRSKITQTSVTTSPFKRSRKKKTLAQLKEEESVLLKERNGLRNELATMQDLLKQQRARNESLKKLQAESQKNDDSSFLLPDLNIALDNNSSPESLYGTS

SEQ ID NO: 7349 - protein, 233 aa, Brassica napus
  misc_feature (1)..(233): useful for making plants with modified plant phenotypes as described in USSN 12/139,269
  misc_feature (1)..(233): Ceres CLONE ID no. 966755
  misc_feature (1)..(233): Utility: Useful for making plants sterile and for genetic confinement
  misc_feature (1)..(233): Utility: Useful for making plants with altered leaf shape eg curled leaves
  misc_feature (1)..(233): Utility: Useful for making smaller plants
  misc_feature (1)..(233): Utility: Useful for modifying plant structure, ie increased branching
  misc_feature (148)..(148): Xaa is any aa, unknown or other
MTTVKDEWVAAAMTDDQMVVELLLRLKHAGTVAAENPETNLRWGIRQRRSRSSRFGGGVTLKKGVDSVRGSPKTPLSWSGGSGSGGASASPSAEDTSRQASCSTSAGSGSKAFPTNEITSCFPKRLKNKKSTSELKHEENLKLKERLXLEKEIASLRATFDQQNVMNQRLKRIKLDLNSGHVKNETPVDLIRKSQGESKPCRMEGKTATSESLFFLPDLNITPSEDELLYGTS

SEQ ID NO: 7350 - protein, 248 aa, Glycine max
  misc_feature (1)..(248): useful for making plants with modified plant phenotypes as described in USSN 12/139,269
  misc_feature (1)..(248): Ceres CLONE ID no. 584341
  misc_feature (1)..(248): Utility: Useful for making plants sterile and for genetic confinement
  misc_feature (1)..(248): Utility: Useful for making plants with altered leaf shape eg curled leaves
  misc_feature (1)..(248): Utility: Useful for making smaller plants
  misc_feature (1)..(248): Utility: Useful for modifying plant structure, ie increased branching
MSDDHWIKVAMADDSLVVDLLLRLHRPPPPPPPCLNLHWTVRQRRSRSAHNKAESTRASPTTPLSWSGATSASGGNLDGYEEYSRPSKPTQTSRSKVANPSETTTTRKTRRKKTLAELKAEEDLLLKERRNLKKELAFLRLTVEKHRATNESIKRKKLDFESRQNSSAAATASEVSGKAVNGSFQFVKAECHPSNSVSHDDSPVCAANVSPKAQDNIGNQESTFVLPDLNLPVDEDISANIMHYIELS

SEQ ID NO: 7351 - protein, 238 aa, Glycine max
  misc_feature (1)..(238): useful for making plants with modified plant phenotypes as described in USSN 12/139,269
  misc_feature (1)..(238): Ceres CLONE ID no. 466978
  misc_feature (1)..(238): Utility: Useful for making plants sterile and for genetic confinement
  misc_feature (1)..(238): Utility: Useful for making plants with altered leaf shape eg curled leaves
  misc_feature (1)..(238): Utility: Useful for making smaller plants
  misc_feature (1)..(238): Utility: Useful for modifying plant structure, ie increased branching
MCDDHWVKVAMADDSLVVDLLLRLHRSPPPPPCLNLHWTVRQRRSRSAHNKAESTRASPTTPLSWSGATSASGGNLDGYEESKPSQTSRSKVANPSETATTRKTRRKKTLTELKEEEDLLLKERRNLEKELASLRLTIQKHRATNESIKRLKLDFESRQNSSAAATASEVSGKAVNGPFQFVKSECHPSNSVTHDDSPVCAANASPKAQDNIGNRESTFVLPDLNLPADEDINANVMH

SEQ ID NO: 7352 - DNA, 712 bp, Arabidopsis thaliana
  misc_feature (1)..(712): useful for making plants with modified plant phenotypes as described in USSN 12/139,269
  misc_feature (1)..(712): Ceres CLONE ID no. 15343
  misc_feature (1)..(712): Also known as  Ceres CDNA ID no. 23390013
aatcaaaaccgagttcaattcactaaaccaatgaaaatgcaagcagttcttgttatcttggttttctccggtttactttcggttaagacagcgttagcagcacaacatgtgatcggcggtagccaaggctgggaacaatccgttgattttgattcttggtcttctgatcaatctttcaaagtcggcgaccaaattgtttttaagtattcaggactacacagcgttgtggagctaggaagtgaaacggcatacaagagttgtgacctgggaacatcagttaactccttaagctctggaaacgacgtcgttaagctttccaaaaccggtactcgttacttcgtttgtggaaccgttggacattgcgaacaaggcatgaagatcaaagtcaacgttgttgactccaaatccggttcctctccttcaggttcgggttcgggttcagattcagggtcgggttctaaatctagttcgggtgatgggctacgtgcttccattgggtacatgttcgttgttggatcgttggttattggtcttatttgggcttactaataattgtctagggcttttttgtaatgtatcgaatatatttggtggggagagaataaatatttttggaattattaattcgtacttgttgttgtattttatatagttcggatatttgcatttctgatctaattttctatatatatcttgtttttcatgttttctc

SEQ ID NO: 7353 - protein, 172 aa, Arabidopsis thaliana
  misc_feature (1)..(172): useful for making plants with modified plant phenotypes as described in USSN 12/139,269
  misc_feature (34)..(115): Pfam Name: Cu_bind_like; Pfam Description: Plastocyanin-like domain
  misc_feature (1)..(172): Utility: Useful for making plants sterile and for genetic confinement
MKMQAVLVILVFSGLLSVKTALAAQHVIGGSQGWEQSVDFDSWSSDQSFKVGDQIVFKYSGLHSVVELGSETAYKSCDLGTSVNSLSSGNDVVKLSKTGTRYFVCGTVGHCEQGMKIKVNVVDSKSGSSPSGSGSGSDSGSGSKSSSGDGLRASIGYMFVVGSLVIGLIWAY

SEQ ID NO: 7354 - protein, 156 aa, Triticum aestivum
  misc_feature (1)..(156): useful for making plants with modified plant phenotypes as described in USSN 12/139,269
  misc_feature (1)..(156): Ceres CLONE ID no. 773730
  misc_feature (1)..(156): Utility: Useful for making plants sterile and for genetic confinement
  misc_feature (141)..(141): Xaa is any aa, unknown or other
MAILSTASAAIYNVGEPGGAWDLSTNYGTWASSRNFKADDQIVFKYSPQAHDVLEVSKADYDSCSTASPITTLNSGNDVVTLTASGTRYFICGFPGHCAGGMKVKIDVMSGFSSPAPASGPSASNAPPPTPASAATNVEAXGFGLAVLLAVAGLMA

SEQ ID NO: 7355 - protein, 171 aa, Triticum aestivum
  misc_feature (1)..(171): useful for making plants with modified plant phenotypes as described in USSN 12/139,269
  misc_feature (1)..(171): Ceres CLONE ID no. 729952
  misc_feature (1)..(171): Utility: Useful for making plants sterile and for genetic confinement
MAAARTILLAMAAMAILSTTSAAIYNVGEPGGAWDLSTNYGTWASSRNFHPNDQIIFKYSPQAHDVLEVSKADYDSCSAASTIATLNSGNDVVSLTATGTRYFLCGYPGHCAGGMKVKIDVVPRSSSSSPAPSSGPSASSAPPPAPVAAATSMEATGFGLTILLAVAGLMA

SEQ ID NO: 7356 - protein, 167 aa, Zea mays
  misc_feature (1)..(167): useful for making plants with modified plant phenotypes as described in USSN 12/139,269
  misc_feature (1)..(167): Ceres CLONE ID no. 276252
  misc_feature (1)..(167): Utility: Useful for making plants sterile and for genetic confinement
MVAAAAVLLALAAVATEVAAAGTTYTVGAPDGLWDMQTDYAQWVKSKTFRPGDTITFTYSPELHDVVEVTRAGYDACSSANNISAFRTGNDAVPLTAVGTRYFLCGLTGHCGNGMKIRVDVVAAAASPSAPGPAAAAAAPPTTSSPCNVGVVAASLLLLLLHAVVSY

SEQ ID NO: 7357 - DNA, 791 bp, Arabidopsis thaliana
  misc_feature (1)..(791): useful for making plants with modified plant phenotypes as described in USSN 12/139,269
  misc_feature (1)..(791): Ceres CLONE ID no. 22007
  misc_feature (1)..(791): Also known as  Ceres CDNA ID no. 23386366
aattagttttggttagtacctgcaggttcttggtttttaaagtcaaagtctcttttgtgcttctcgtaaagagcgatcatgaaagtgcttctcggtcttttgcttctcttgtccttgaccaattcttcaagtgcaatttactgtctctgtaaagatgggataggagacacagagcttcaaacatcaatagactatgcatgtggaaccttagctgattgtaatcctatacatgataagggtacttgttatcaaccagacaccatcaaaagccactgtgattgggctgtgaatagctacttccaaaacgcagctcaagtccctggaagctgcaatttctctggcactgccactaccaatccaaacccaccttccaatttggctaatggttgcatctatccgtcaagccctagctctactaggtctcctccatcaacaacaccaccaacgggaacaactcccacaaacggaaccactccatttccgggaactccatttccaggaacaccgttcccgggaactcctccggtgtttggtccaaccggagtcttcaacccaagcaacccaggcagtggtgcttcaagtttgggcacctcctctgttttcacactctgtttttcattactagcctttctatggggctctgatgtaaggttcggatttagccacgtgtagagactaaaagacatccacttgtgttagtctttgattctattttgggtggaacaagaagcttaggcgtttgttgagctttcgtctatgtaaaggttgctctaatagaaagaatcttgagt

SEQ ID NO: 7358 - protein, 197 aa, Arabidopsis thaliana
  misc_feature (1)..(197): useful for making plants with modified plant phenotypes as described in USSN 12/139,269
  misc_feature (20)..(106): Pfam Name: X8; Pfam Description: X8 domain
  misc_feature (1)..(197): Utility: Useful for making plants sterile and for genetic confinement
  misc_feature (1)..(197): Utility: Useful for making smaller plants
MKVLLGLLLLLSLTNSSSAIYCLCKDGIGDTELQTSIDYACGTLADCNPIHDKGTCYQPDTIKSHCDWAVNSYFQNAAQVPGSCNFSGTATTNPNPPSNLANGCIYPSSPSSTRSPPSTTPPTGTTPTNGTTPFPGTPFPGTPFPGTPPVFGPTGVFNPSNPGSGASSLGTSSVFTLCFSLLAFLWGSDVRFGFSHV

SEQ ID NO: 7359 - protein, 198 aa, Triticum aestivum
  misc_feature (1)..(198): useful for making plants with modified plant phenotypes as described in USSN 12/139,269
  misc_feature (1)..(198): Ceres CLONE ID no. 700212
  misc_feature (1)..(198): Utility: Useful for making plants sterile and for genetic confinement
  misc_feature (1)..(198): Utility: Useful for making smaller plants
MEAPLLVAALLLLSSTLVVSEFCVCRSEQPQAALQKTIDYACGAGADCNSIHEQGPCYNPNNVVSHCSWAANSYFQKKRAMGATCDFGGTALVVSTDPSSSGCSYPSSASAAGTSTTPTGTGTGIGGTTGGTPGTFTPGAGTSTGGMGGTGTGTDTTTGFGGLGPTGTSNMDTAAAGLHPRSGAPAFLAVLLSFLAFA

SEQ ID NO: 7360 - protein, 191 aa, Triticum aestivum
  misc_feature (1)..(191): useful for making plants with modified plant phenotypes as described in USSN 12/139,269
  misc_feature (1)..(191): Public GI no. 50939031
  misc_feature (1)..(191): Utility: Useful for making plants sterile and for genetic confinement
  misc_feature (1)..(191): Utility: Useful for making smaller plants
MEAVVVAALVLLMSSSLVASWCVCRSDQPQAALQKTIDYACGAGADCNSIHEQGQCFNPNTVVAHCSWAANSYFQRNRAMGATCDFTGTATLTTSDPVSGCSFPASAGAGTSTTPTMGGTTGTMTPGTFTPGTGMGTTTGTGMGTGTTTGTGLGGLGPTGTSSMDTAAAGLHLRAGLATFCTVLLSFVAIA

SEQ ID NO: 7361 - DNA, 834 bp, Arabidopsis thaliana
  misc_feature (1)..(834): useful for making plants with modified plant phenotypes as described in USSN 12/139,269
  misc_feature (1)..(834): Ceres CLONE ID no. 23771
  misc_feature (1)..(834): Also known as  Ceres CDNA ID no. 23367513
ttccactttaaatcaggaacaaacccttcactgcgccagtgttgtgcggctctgcgaatcttcgaaaatgggtgcgtacaagtatgtatctgagctatggaggaagaagcagtccgatgtgatgagattcctccagagggttaggtgctgggaatacagacagcaaccttcgattgttcgtctcgtcaggcctactcgtcctgataaggctcgtcgtttgggttacaaggccaagcagggctttgttgtgtaccgtgtccgtgtgagacgtggtggacgcaagaggccagtgcctaagggtattgtgtatggtaagccaacaaaccagggagtgacacaactcaagttccagcgtagcaagcggtctgttgctgaggagcgtgctggcaggaaattgggtggtctcagagttgtcaactcttactggctcaatgaggattcgacctacaagtactacgagatcatcttggttgacccagcacacaatgctgtgcgtaatgacccgagaatcaactggatctgcaacccagttcacaagcaccgtgagctcagaggacttacctcagagggaaagaagaacagaggtctccgcggaaagggtcacaacaaccacaagaaccgtccatctcgcagggctacatggaagaaaaacaactctctcagccttcgtcgttaccgttgattgccttttgcttttattattactgttatcatcttctaggttccatgttgttgcacttttatctctctcaggatgacttgtttttgcaaattttggaaactatacaattgtgctttgaacctaaattttatatttgctttgcttttttgtcg

SEQ ID NO: 7362 - protein, 204 aa, Arabidopsis thaliana
  misc_feature (1)..(204): useful for making plants with modified plant phenotypes as described in USSN 12/139,269
  misc_feature (2)..(193): Pfam Name: Ribosomal_L15e; Pfam Description: Ribosomal L15
  misc_feature (1)..(204): Utility: Useful for making plants sterile and for genetic confinement
  misc_feature (1)..(204): Utility: Useful for making plants with increased biomass
  misc_feature (1)..(204): Utility: Useful for making smaller plants
MGAYKYVSELWRKKQSDVMRFLQRVRCWEYRQQPSIVRLVRPTRPDKARRLGYKAKQGFVVYRVRVRRGGRKRPVPKGIVYGKPTNQGVTQLKFQRSKRSVAEERAGRKLGGLRVVNSYWLNEDSTYKYYEIILVDPAHNAVRNDPRINWICNPVHKHRELRGLTSEGKKNRGLRGKGHNNHKNRPSRRATWKKNNSLSLRRYR

SEQ ID NO: 7363 - protein, 213 aa, Zea mays
  misc_feature (1)..(213): useful for making plants with modified plant phenotypes as described in USSN 12/139,269
  misc_feature (1)..(213): Ceres CLONE ID no. 1429265
  misc_feature (1)..(213): Utility: Useful for making plants sterile and for genetic confinement
  misc_feature (1)..(213): Utility: Useful for making plants with increased biomass
  misc_feature (1)..(213): Utility: Useful for making smaller plants
  misc_feature (21)..(21): Xaa is any aa, unknown or other
  misc_feature (23)..(23): Xaa is any aa, unknown or other
  misc_feature (25)..(25): Xaa is any aa, unknown or other
  misc_feature (27)..(27): Xaa is any aa, unknown or other
  misc_feature (28)..(28): Xaa is any aa, unknown or other
  misc_feature (29)..(29): Xaa is any aa, unknown or other
  misc_feature (32)..(32): Xaa is any aa, unknown or other
  misc_feature (33)..(33): Xaa is any aa, unknown or other
  misc_feature (35)..(35): Xaa is any aa, unknown or other
  misc_feature (36)..(36): Xaa is any aa, unknown or other
  misc_feature (37)..(37): Xaa is any aa, unknown or other
  misc_feature (38)..(38): Xaa is any aa, unknown or other
  misc_feature (40)..(40): Xaa is any aa, unknown or other
  misc_feature (42)..(42): Xaa is any aa, unknown or other
  misc_feature (47)..(47): Xaa is any aa, unknown or other
  misc_feature (50)..(50): Xaa is any aa, unknown or other
  misc_feature (52)..(52): Xaa is any aa, unknown or other
  misc_feature (53)..(53): Xaa is any aa, unknown or other
  misc_feature (82)..(82): Xaa is any aa, unknown or other
  misc_feature (83)..(83): Xaa is any aa, unknown or other
  misc_feature (86)..(86): Xaa is any aa, unknown or other
  misc_feature (121)..(121): Xaa is any aa, unknown or other
  misc_feature (122)..(122): Xaa is any aa, unknown or other
SNCDAGNQQWGRTSTCLSYGXRXSXMXXXLFXXLXXXXIXQXPSIVXLVXPXXPDKARRLGYKAKQGFVVYRVRVRRGGRKXXVPXGIVYGKPTNQGVTQLKFQRSKRSVAEERAGRKLSXXRVVNSYWLNEDSTYKYYEIILVDPAHNAIRNDPRINWICNPVHKHRELRGLTSEGKKNRGLRGKGHNNHKNRPSRRATWKKNNSLSLRRYR

SEQ ID NO: 7364 - protein, 186 aa, Glycine max
  misc_feature (1)..(186): useful for making plants with modified plant phenotypes as described in USSN 12/139,269
  misc_feature (1)..(186): Ceres CLONE ID no. 1050058
  misc_feature (1)..(186): Utility: Useful for making plants sterile and for genetic confinement
  misc_feature (1)..(186): Utility: Useful for making plants with increased biomass
  misc_feature (1)..(186): Utility: Useful for making smaller plants
MRFLQRVRCWEYRQQPSIVRLTRSTRPDKARRLGFKAKQGYVIYRVRVRRGGRKRPVPKGIVYGKPTNQGVTQLKFQRSKRSVAEERAGRKLGGLRVLNSYWVNEDSTYKYFEVILVDVAHSAVRNDPRINWLCNPVHKHRELRGLTSAGKSNRGLRGRGHLYHKNRPSRRATWKRNNTLSLRRYR

SEQ ID NO: 7365 - protein, 204 aa, Zea mays
  misc_feature (1)..(204): useful for making plants with modified plant phenotypes as described in USSN 12/139,269
  misc_feature (1)..(204): Ceres CLONE ID no. 312541
  misc_feature (1)..(204): Utility: Useful for making plants sterile and for genetic confinement
  misc_feature (1)..(204): Utility: Useful for making plants with increased biomass
  misc_feature (1)..(204): Utility: Useful for making smaller plants
MGAYKYVSELWRRKQSDVMRFVQRVRCWEYRQQPAIVRLTRPTRPDKARRLGFKAKQGYVVYRVRVRRGGRKRPVPKGIVYGKPKHQGITQLKFQRNKRSVAEERAGRKLGGLRVLNSYWVNEDSTYKYFEIILVDVAHTAIRNDPRINWLCNPVHKHRELRGLTSAGKKFRGLRGKGHTHHKNRPSRRATWKRNQTLSLRRYR

SEQ ID NO: 7366 - protein, 204 aa, Zea mays; identical to SEQ ID NO: 7365
  misc_feature (1)..(204): useful for making plants with modified plant phenotypes as described in USSN 12/139,269
  misc_feature (1)..(204): Ceres CLONE ID no. 1544938
  misc_feature (1)..(204): Utility: Useful for making plants sterile and for genetic confinement
  misc_feature (1)..(204): Utility: Useful for making plants with increased biomass
  misc_feature (1)..(204): Utility: Useful for making smaller plants

SEQ ID NO: 7367 - protein, 204 aa, Zea mays
  misc_feature (1)..(204): useful for making plants with modified plant phenotypes as described in USSN 12/139,269
  misc_feature (1)..(204): Ceres CLONE ID no. 210309
  misc_feature (1)..(204): Utility: Useful for making plants sterile and for genetic confinement
  misc_feature (1)..(204): Utility: Useful for making plants with increased biomass
  misc_feature (1)..(204): Utility: Useful for making smaller plants
MGAYKYVSELWRRKQSDVMRFVQRMRCWEYRQQPAIVRLTRPTRPDKARRLGYKAKQGYVVYRVRVRRGGRKRPVPKGIVYGKPKHQGITQLKFQRNKRSVAEERAGRKLGGLRVLNSYWVNEDSTYKYFEIILVDVAHTTIRNDPRINWLCNPVHKHRELRGLTSAGKKFRGLRGKGHTHHKNRPSRRATWKRNQTLSLRRYR

SEQ ID NO: 7368 - protein, 204 aa, Zea mays
  misc_feature (1)..(204): useful for making plants with modified plant phenotypes as described in USSN 12/139,269
  misc_feature (1)..(204): Ceres CLONE ID no. 291474
  misc_feature (1)..(204): Utility: Useful for making plants sterile and for genetic confinement
  misc_feature (1)..(204): Utility: Useful for making plants with increased biomass
  misc_feature (1)..(204): Utility: Useful for making smaller plants
MGAYKYVSELWRRKQSDVMRFVQRVRCWEYRQQPSIVRLTRPTRPDKARRLGYKAKQGYVVYRVRVKRGGRKRPVPKGIVYGKPKHQGITQLKFQRNKRSVAEERAGRKLGGLRVLNSYWVNEDSTYKYFEIILVDVAHKAIKTDPRINWLCNPVHKHRELRGLTSAGKKYRGLRGKGHTHHKNRPSRRATWKRNQTLSLRRYR

SEQ ID NO: 7369 - protein, 204 aa, Zea mays
  misc_feature (1)..(204): useful for making plants with modified plant phenotypes as described in USSN 12/139,269
  misc_feature (1)..(204): Ceres CLONE ID no. 221519
  misc_feature (1)..(204): Utility: Useful for making plants sterile and for genetic confinement
  misc_feature (1)..(204): Utility: Useful for making plants with increased biomass
  misc_feature (1)..(204): Utility: Useful for making smaller plants
  misc_feature (6)..(6): Xaa is any aa, unknown or other
MGAYKXVSELWRRKQSDVMRFVQRVRCWEYRQQPSIVRLTRPTRPDKARRLGYKAKQGYVVYRVRVKRGGRKRPVPKGIVYGKPKHQGITQLKFQRNKRSVAEERAGRKLGGLRVLNSYWVNEDSTYKYFEIILVDVAHKAIKTDPRINWLCNPVHKHRELRGLTSAGKKYRGLRGKGHTHHKNRPSRRATWKRNQTLSLRRYR

SEQ ID NO: 7370 - protein, 186 aa, Zea mays
  misc_feature (1)..(186): useful for making plants with modified plant phenotypes as described in USSN 12/139,269
  misc_feature (1)..(186): Ceres CLONE ID no. 297035
  misc_feature (1)..(186): Utility: Useful for making plants sterile and for genetic confinement
  misc_feature (1)..(186): Utility: Useful for making plants with increased biomass
  misc_feature (1)..(186): Utility: Useful for making smaller plants
MRFVQRVRCWEYRQQPAIVRLTRPTRPDKARRLGYKAKQGYVVYRVRVKRGGRKRPVPKGIVYGKPKHQGITQLKFQRNKRSVAEERAGRKLGGLRVLNSYWVNEDSTYKYFEIILVDVAHTAIRKDPRINWLCNPVHKHRELRGLTSAGKKFRGLRGKGHTHHKNRPSRRATWKRNQTLSLRRYR

SEQ ID NO: 7371 - protein, 204 aa, Zea mays
  misc_feature (1)..(204): useful for making plants with modified plant phenotypes as described in USSN 12/139,269
  misc_feature (1)..(204): Ceres CLONE ID no. 1064683
  misc_feature (1)..(204): Utility: Useful for making plants sterile and for genetic confinement
  misc_feature (1)..(204): Utility: Useful for making plants with increased biomass
  misc_feature (1)..(204): Utility: Useful for making smaller plants
MGAYKFVSELWRRKQSDVMRFVQRVRCWEYRQQPAIVRITRPTRPDRARRLGFKAKQGYVFYRVRVKRGGRKRPVPKGIVYGKPKHQGITQLKFQRNKRSVAEERAGRKLGGLRVLNSYWVNEDSTYKYFEIILVDVAHKAIKTDPRINWLCNPVHKHRELRGLTSAGKKFRGLRGKGHTHHKNRPSRRATWKRNQTLSLRRYR

SEQ ID NO: 7372 - DNA, 1252 bp, Arabidopsis thaliana
  misc_feature (1)..(1252): useful for making plants with modified plant phenotypes as described in USSN 12/139,269
  misc_feature (1)..(1252): Ceres CLONE ID no. 24644
  misc_feature (1)..(1252): Also known as  Ceres CDNA ID no. 23369467
aacaagaacacagtaacgcaatcacagactccacagtccaaggagttttgcatactcaccaagccacaatcatttctctcttctctatctctctggttttgaatcggcgacgactgagtcaactcggtgttgttactggtttcgtcgtatgtgttgtaactgattaagttgatggatccgagtgggatgatgaacgaaggaggaccgtttaatctagcggagatctggcagtttccgttgaacggagtttcaaccgccggagattcttctagaagaagcttcgttggaccgaatcagttcggtgatgctgatctaaccacatctgctaacggtgatccagcgcgtatgagtcacgcgttgtctcaggcggttattgaaggtatctccggcgcttggaaacggagggaagatgagtctaagtcggcgaagatcgtctccaccattggcgctagtgaaggtgagaacaaaagacagaagatagatgaagtgtgtgatgggaaagcagaagcagaatcgctaggaacagagacggaacaaaagaagcaacagatggaaccaacgaaagattatattcatgttcgagctagaagaggtcaagctactgatagtcacagtttagctgaaagagcgagaagagagaaaataagtgagcggatgaaaatcttgcaagatcttgttccgggatgtaacaaggttattggaaaagcacttgttctagatgagataattaactatatacaatcattgcaacgtcaagttgagttcttatcgatgaagcttgaagcagtcaactcaagaatgaaccctggtatcgaggtttttccaccaaaagagtttggtcagcaagcgtttgagaatccggagatacagttcgggtcgcagtctacgagggaatacagtagaggagcatcaccagagtggttgcatatgcagataggatcaggtggtttcgaaagaacgtcttgataaagaaacaacacttggtcatcatcttactacaaataagatctaaaagctctaatatcccgagaagaaaaagcatacatacatataaatctcattctcattataggtttaaatatatggatgtgaatatacacatcatattgttgttctaaagaaagcaaaatagaaaagaagatatagttagtttcgacatcaagaaaaaacaagctgggaagggtttaaagtagaaaaaaactcttgtaaaagaaagaacgtttgttgttataaaattgtatctcatttttac

SEQ ID NO: 7373 - protein, 264 aa, Arabidopsis thaliana
  misc_feature (1)..(264): useful for making plants with modified plant phenotypes as described in USSN 12/139,269
  misc_feature (143)..(193): Pfam Name: HLH; Pfam Description: Helix-loop-helix DNA-binding domain
  misc_feature (143)..(193): Pfam Name: HLH; Pfam Description: Helix-loop-helix DNA-binding domain
  misc_feature (1)..(264): Utility: Useful for making plants sterile and for genetic confinement
  misc_feature (1)..(264): Utility: Useful for making smaller plants
  misc_feature (1)..(264): Utility: Useful for making taller plants
MDPSGMMNEGGPFNLAEIWQFPLNGVSTAGDSSRRSFVGPNQFGDADLTTSANGDPARMSHALSQAVIEGISGAWKRREDESKSAKIVSTIGASEGENKRQKIDEVCDGKAEAESLGTETEQKKQQMEPTKDYIHVRARRGQATDSHSLAERARREKISERMKILQDLVPGCNKVIGKALVLDEIINYIQSLQRQVEFLSMKLEAVNSRMNPGIEVFPPKEFGQQAFENPEIQFGSQSTREYSRGASPEWLHMQIGSGGFERTS

SEQ ID NO: 7374 - DNA, 1161 bp, Arabidopsis thaliana
  misc_feature (1)..(1161): useful for making plants with modified plant phenotypes as described in USSN 12/139,269
  misc_feature (1)..(1161): Ceres CLONE ID no. 27197
  misc_feature (1)..(1161): Also known as  Ceres CDNA ID no. 23385579
tcggctaatccttggtccgtgctaagatcttagatcgatttctaaagtcttcgtcttcttcttcttctgataactagatttttcaatcttctgaagctttaattttttcatagccatggctaatcgttatgatccaaatcctttcgctgaggaagaagaagtcaatcctttcgctaatgctagaggagttccacctgcgtcgaattcgagactttcgcctttgcctccagagcctgttggtttcgattatggtcgaaccgtagacattcctcttgacagagctggtacacaggatttgaagaagaaagagaaggaactccaagccaaagaagctgagctaaaacgacgagagcaggacctcaaacggaaagaagatgctgctgcacgagctggaatcgttatcgaagtgaaaaactggccgcctttcttcccgcttatccaccatgatattgcaaatgaaattccggttcatctccaaagactacagtatgttacctttgcaacgtatttggggttggttctttgtcttttctggaatatcatcgccgttactacagcttggatcaaaggagaaggagtgacgatatggcttcttgccttaatttacttcatagcgggtgttccaggaggctatgtgttatggtatcgaccactctaccgtgccttcagaactgatagtgcattgagctttggatggtttttcttgttctatatgctccacattgctttctgcgtctttgctgcagttgctccacctgtcgtcttcaaaggaaaatctcttgctgggatcttacctgcaatagatgtcttaagcggtcaagcaattgttgggatattctacttcattgggtttgcatttttctgcctcgaatcagtggttagcatctgggttatacagcaagtgtatatgtacttccgaggcagcgggaaacaagatcaaatgagacgggaagcagcgagaggagccttgagagccgctgtttgagagttctccttgtaacattctggtttgtgtatgcactgtttcttttttcagattttcttgaagtctctctctctctctctctctctgctctataaacaaaaaaaaaaagatttaatttttcctttgtacctttatgtcatgtaaatttgtttgttcaaaaatcagagttcagattc

SEQ ID NO: 7375 - protein, 289 aa, Arabidopsis thaliana
  misc_feature (1)..(289): useful for making plants with modified plant phenotypes as described in USSN 12/139,269
  misc_feature (97)..(271): Pfam Name: SCAMP; Pfam Description: SCAMP family
  misc_feature (1)..(289): Utility: Useful for making plants sterile and for genetic confinement
  misc_feature (1)..(289): Utility: Useful for making smaller plants
MANRYDPNPFAEEEEVNPFANARGVPPASNSRLSPLPPEPVGFDYGRTVDIPLDRAGTQDLKKKEKELQAKEAELKRREQDLKRKEDAAARAGIVIEVKNWPPFFPLIHHDIANEIPVHLQRLQYVTFATYLGLVLCLFWNIIAVTTAWIKGEGVTIWLLALIYFIAGVPGGYVLWYRPLYRAFRTDSALSFGWFFLFYMLHIAFCVFAAVAPPVVFKGKSLAGILPAIDVLSGQAIVGIFYFIGFAFFCLESVVSIWVIQQVYMYFRGSGKQDQMRREAARGALRAAV

SEQ ID NO: 7376 - protein, 291 aa, Brassica napus
  misc_feature (1)..(291): useful for making plants with modified plant phenotypes as described in USSN 12/139,269
  misc_feature (1)..(291): Ceres CLONE ID no. 980747
  misc_feature (1)..(291): Utility: Useful for making plants sterile and for genetic confinement
  misc_feature (1)..(291): Utility: Useful for making smaller plants
MAGRYDRNPFDEGDEVNPFANPGSVPAASSSRLSPLPPEPAGFGFGRTVDVPLDRPGSGAQDLKKKEKELQAKEAELKRREQDLKRKEDAAARAGIVIEVKNWPPLFPLIHHDIANEIPIRLQRLQYIAFSTYLGLVLALFWNVIAVTTAWIKGEGVTIWLLALIYFISGVPGGYVLWYRPLYRAFRNDSALSFGWFFLFYMLHIAFCVFAAVAPPVVFKGKSLAGILPALDMLSSQALVGIFYFIGFAFFCLESVVSIWVIQQVYMYFRGSGKADEMKRDAARGAMRAAV

SEQ ID NO: 7377 - protein, 291 aa, Glycine max; identical to SEQ ID NO: 7376
  misc_feature (1)..(291): useful for making plants with modified plant phenotypes as described in USSN 12/139,269
  misc_feature (1)..(291): Ceres CLONE ID no. 1075340
  misc_feature (1)..(291): Utility: Useful for making plants sterile and for genetic confinement
  misc_feature (1)..(291): Utility: Useful for making smaller plants

SEQ ID NO: 7378 - protein, 291 aa, Glycine max
  misc_feature (1)..(291): useful for making plants with modified plant phenotypes as described in USSN 12/139,269
  misc_feature (1)..(291): Public GI no. 15220305
  misc_feature (1)..(291): Utility: Useful for making plants sterile and for genetic confinement
  misc_feature (1)..(291): Utility: Useful for making smaller plants
MGGRYDRNTFDEQDEVNPFANPGSVPAASNSRLSPLPPEPAGFGYGRTVDIPLDRPGSGAQDLKKKEKELQAKEADLRRREQDLKRKQDAAARAGIVIEAKNWPTFFPLIHHDIANEILVRLQRLQYIAFATYLGLVLALFWNIIAVTTAWIKGEGVTIWLLAVIYFISGVPGGYVLWYRPLYRAFRSDSAFNFGWFFLFYMLHILFCLFAAVAPPIVFKGKSLAGILPAIDVLSAQALVGIFYFIGFGLFCLESVVSIWVIQQVYMYFRGSGKADDMRRDAARGAMRAAI

SEQ ID NO: 7379 - protein, 288 aa, Glycine max
  misc_feature (1)..(288): useful for making plants with modified plant phenotypes as described in USSN 12/139,269
  misc_feature (1)..(288): Ceres CLONE ID no. 580349
  misc_feature (1)..(288): Utility: Useful for making plants sterile and for genetic confinement
  misc_feature (1)..(288): Utility: Useful for making smaller plants
MAGRYDSNPFDEEEVNPFYNPGSVPAATNSRLSPLKPEPVDYNYGFGATVDIPLDSSTDLKKKEKELQAKETELRKREQEVRRREEAASRAGIVLEEKNWPPFFPIIHHDIANEIPIHLQKLQYVAFTTLLGLVLCLFWNVIAVTAAWIKGEGVKIWFLAIIYFIAGVPGAYVLWYRPLYRAFRNESALKFGWFFMFYLLHIGFCILAAVAPPIVFKGKSLTGILAAIDVLGDHALIGIFYFIGFGLFCVETLISIWVIQQVYMYFRGSGKAAEMKREAARGALRAAI

SEQ ID NO: 7380 - protein, 286 aa, Glycine max
  misc_feature (1)..(286): useful for making plants with modified plant phenotypes as described in USSN 12/139,269
  misc_feature (1)..(286): Public GI no. 50902072
  misc_feature (1)..(286): Utility: Useful for making plants sterile and for genetic confinement
  misc_feature (1)..(286): Utility: Useful for making smaller plants
MAGRYDRNPFDEDDVNPFAGGSVPPASNSRMPPLPHEPGFYNDRGATVDIPLDSTKDMKKKEKELQAKEAELNKRESELRRREEAASRAGIVIEEKNWPPFFPIIHHDISNEIPIHLQRMQYLAFSSLLGLAACLFWNIIATTAAWIKGAGVMIWLLAIIYFISGVPGAYVLWYRPLYNAMRTESALKFGWFFLFYLIHILFCIWSAVAPPFPFKGKSLAGILPAIDVIGNNAIVGIFYFIGFGLFCLESLLSVVVIQQVYMYFRGSGKAAEMKREAARGAMRSAF

SEQ ID NO: 7381 - protein, 282 aa, Zea mays
  misc_feature (1)..(282): useful for making plants with modified plant phenotypes as described in USSN 12/139,269
  misc_feature (1)..(282): Ceres CLONE ID no. 219387
  misc_feature (1)..(282): Utility: Useful for making plants sterile and for genetic confinement
  misc_feature (1)..(282): Utility: Useful for making smaller plants
MAGKHGRNGFDDDNVNPFAGGSVPPATNSRLSPLSHEPADFYNVDIPLDSSKDLKKKEKELQAMEAELNKRERELKRKEEAASRAGVVIEEKNWPPFFPLIHHDISNEIPIHLQRMQYLAFSSFLGLIACLFWNVIATTTAWIKGEGVMIWLLAIIYFISGAPGAYVLWYRPLYNAMRTESALKFGWFFLFYMIHIIFCVWAAVAPPFPFKGKSLAGILPAIDVISKNAIVGIFYFVGFGLFCLESLLSIGVIQQVYMYFRGSGKAAEMKREAARSALSSAF

SEQ ID NO: 7382 - protein, 282 aa, Zea mays; identical to SEQ ID NO: 7381
  misc_feature (1)..(282): useful for making plants with modified plant phenotypes as described in USSN 12/139,269
  misc_feature (1)..(282): Ceres CLONE ID no. 325927
  misc_feature (1)..(282): Utility: Useful for making plants sterile and for genetic confinement
  misc_feature (1)..(282): Utility: Useful for making smaller plants

SEQ ID NO: 7383 - protein, 287 aa, Triticum aestivum
  misc_feature (1)..(287): useful for making plants with modified plant phenotypes as described in USSN 12/139,269
  misc_feature (1)..(287): Ceres CLONE ID no. 699286
  misc_feature (1)..(287): Utility: Useful for making plants sterile and for genetic confinement
  misc_feature (1)..(287): Utility: Useful for making smaller plants
MAGRYDRNPFDEDDVNPFAGGGVPPASNSRMPPLPHEPAGFYNDRAATVDIPLGSSKDLKQKEKELQSKEAELNKRERELKRREEAAARAGIVIETKNWPPFMPIIHHDISNEIPIHLQRMQYLAFCSLLGLTLCLFWNIIATTAAWIKGAGVVIWLLAIIYFISGVPGAYVLWYRPLYNAMRTESALKFGWFFLLYLIHIIFCIWSAVSPPFPFKGKSIAGFLPAIDVIGSNVIVGIFYFVGFGLFCLEALLSIVVIQQVYMYFRGSGKAAQMRQEAARGAMRSAF

SEQ ID NO: 7384 - DNA, 967 bp, Arabidopsis thaliana
  misc_feature (1)..(967): useful for making plants with modified plant phenotypes as described in USSN 12/139,269
  misc_feature (1)..(967): Ceres CLONE ID no. 33802
  misc_feature (1)..(967): Also known as  Ceres CDNA ID no. 13593739
  misc_feature (862)..(862): s is g or c
aagcagaggagttatactttactacttactaatctctccctctctctatctgactctttgatcggaaaaaatggcggagaaaaatgcgagcgcggtggacggtgcaattagggttagtggaatgcagttttcttacgatgttcaagatcctattttcttcgattttaatctcgatcttcccgctggatctcgttgcctcttggttggtgccaatggatctgggaaaaccacattattgaagattttggctggaaagcatatggttggaggaaagaatgttgtacaagtgctggatcgctcagcatttcatgatacagagcttgtttgtagtggtgatttgtcttaccttggaggatcatggagtaaaactgctggttctgctggtgatattccacttcaaggagacttctcagcagaacatatgatatttggagttgaagggattgatcctttcagaagagagaaattgattgatcttcttgatatcaatcttcaatggcgtatgcataaggtttctgatggacagagacgtcgagtgcaaatatgtatgggtcttttacatccattcaaggtgttactactggatgaggttactgttgacctcgacgttgttgctaggatggatttgttggagttctttaaagaagaatgtgaacagagaggagctacaattgtatatgcaactcatattttcgacgggctcgagacatgggctagtcatctggcttatattaatggaggagagctgaaactctcggccaaattagatgagatcaaggatctcaagacctcaccaaatctgctctctgttgttgaagcttggctccggtctgaaaccaaagttgagaaaaagacgaagaasaaacctgttgttacctctccatttatgtcgtctagacaaatggcatattaccgatgaatcttaacttgtttatgagatcagtaagaataagagcactgcttctac

SEQ ID NO: 7385 - protein, 282 aa, Arabidopsis thaliana
  misc_feature (1)..(282): useful for making plants with modified plant phenotypes as described in USSN 12/139,269
  misc_feature (142)..(224): Pfam Name: ABC_tran; Pfam Description: ABC transporter
  misc_feature (40)..(60): Pfam Name: NACHT; Pfam Description: NACHT domain
  misc_feature (40)..(60): Pfam Name: NACHT; Pfam Description: NACHT domain
  misc_feature (142)..(224): Pfam Name: ABC_tran; Pfam Description: ABC transporter
  misc_feature (1)..(282): Utility: Useful for making plants sterile and for genetic confinement
  misc_feature (1)..(282): Utility: Useful for making smaller plants
MAEKNASAVDGAIRVSGMQFSYDVQDPIFFDFNLDLPAGSRCLLVGANGSGKTTLLKILAGKHMVGGKNVVQVLDRSAFHDTELVCSGDLSYLGGSWSKTAGSAGDIPLQGDFSAEHMIFGVEGIDPFRREKLIDLLDINLQWRMHKVSDGQRRRVQICMGLLHPFKVLLLDEVTVDLDVVARMDLLEFFKEECEQRGATIVYATHIFDGLETWASHLAYINGGELKLSAKLDEIKDLKTSPNLLSVVEAWLRSETKVEKKTKKKPVVTSPFMSSRQMAYYR

SEQ ID NO: 7386 - protein, 277 aa, Brassica napus
  misc_feature (1)..(277): useful for making plants with modified plant phenotypes as described in USSN 12/139,269
  misc_feature (1)..(277): Ceres CLONE ID no. 979847
  misc_feature (1)..(277): Utility: Useful for making plants sterile and for genetic confinement
  misc_feature (1)..(277): Utility: Useful for making smaller plants
  misc_feature (143)..(143): Xaa is any aa, unknown or other
  misc_feature (223)..(223): Xaa is any aa, unknown or other
MARSDGAIRVSGMQFSYDVQDPIFFDFSLDLPAGSRCLLVGANGSGKTTLLKILAGKHMVGGKNIVQVLNRSAFHDTDLVCSGDLSYLGGSWSKTAGSAGEIPLQGDFSAEHMIFGVEGIDPVRREKLIDLLDINLKWRMHKXSDGQRRRVQICMGLLQPFKVLLLDEVTVDLDVVARMDLLEFFKEECEQRGATIVYATHIFDGLETWASHLAYIHGGELKXSAKLKEIKDLETSPNLLSVVENWLRSETKVEKKTKKKPVATSPFMSSRQMAYYR

SEQ ID NO: 7387 - protein, 290 aa, Brassica napus
  misc_feature (1)..(290): useful for making plants with modified plant phenotypes as described in USSN 12/139,269
  misc_feature (1)..(290): Public GI no. 18379174
  misc_feature (1)..(290): Utility: Useful for making plants sterile and for genetic confinement
  misc_feature (1)..(290): Utility: Useful for making smaller plants
MAEKDATASGDDAIRVSGMQFAYEVEDPIFFDFNLDLPAGSRCLLVGANGSGKTTLLKILAGKHMVGGKNVVQVLSRSAFHDTQLVCSGDLSYLGGSWSKTVGSAGEVPLQGDFSAEHMIFGVEGTDPVRREKLIDLLDINLQWRMHKVSDGQKRRVQICMGLLHPFKVLLLDEVTVDLDVVARMDLLEFFKEECDQRGATIVYATHIFDGLETWATHLAYIQDGELNRLSKMTDIEELKTSPNLLSVVESWLRSEIKLVKKKKKPVAPWKPSPFDNSPFRSSRHMAYYR

SEQ ID NO: 7388 - protein, 283 aa, Glycine max
  misc_feature (1)..(283): useful for making plants with modified plant phenotypes as described in USSN 12/139,269
  misc_feature (1)..(283): Ceres CLONE ID no. 603261
  misc_feature (1)..(283): Utility: Useful for making plants sterile and for genetic confinement
  misc_feature (1)..(283): Utility: Useful for making smaller plants
MAAENEDSCGIRVTGMQFSYDVQQPPLFLDFNLNVSPGSRCLLVGANGSGKTTLLKILAGKHMVGGRDVVRVLSGSAFHDTQLVCSGDLAYLGGSWSKNVGSAGEIPLQGDFSAEHMIFGVEGADPERRDKLIELLDIDLQWRMHKVSDGQRRRVQICLGLLHPYKVLLLDEVTVDLDVVTRMDLLDFFKEECEQREAIIVYATHIFDGLETWATHLAYIQDGELRRAEKISNVKELKSSTNLLSVVEAWLRAETKLEKKNPVQKTSVASSPFFSSRHMAYYR

SEQ ID NO: 7389 - protein, 292 aa, Glycine max
  misc_feature (1)..(292): useful for making plants with modified plant phenotypes as described in USSN 12/139,269
  misc_feature (1)..(292): Public GI no. 51964500
  misc_feature (1)..(292): Utility: Useful for making plants sterile and for genetic confinement
  misc_feature (1)..(292): Utility: Useful for making smaller plants
MAGGEDEGWRRSGIEVSALQFDYDGQPPLFARFNLRIAPGSRCLLIGANGSGKTTLLKILAGKHMVGGRDVVRVLNGSAFHDTQLVCNGDLSYLGGSWSRAIGSAGDVPLQGDFSAEHMIFGVDGVDPVRREKLVDLLDIDLQWRMHKVSDGQRRRVQICMGLLHPYKVLLLDEITVDLDVVTRMDLLDFFKEECEQREATIVYATHIFDGLESWATDIAYIQEGELRKSAKYSDVEELKSAKNLLSVVESWLRSETKLPKKEHPRPETQPRRSSPFDASPFRSSRHMAYYR

SEQ ID NO: 7390 - DNA, 1000 bp, Arabidopsis thaliana
  misc_feature (1)..(1000): useful for making plants with modified plant phenotypes as described in USSN 12/139,269
  misc_feature (1)..(1000): Ceres CLONE ID no. 34210
  misc_feature (1)..(1000): Also known as  Ceres CDNA ID no. 23369157
gaatgttcaaaagctgccagattgagaatatttcgtccgtcgttgaaacttgagaatagaggcgaatctggttcgagttagggttccaattgaaaagtttgaagctccttttgactctctctctcttctagatctcgacaactctaacctcttcgatttggtggatcttgagaaattgattttagttcaaagcttctgatggctaaaaaggagagacctagacctgagaagttgtctgtgtatctttatatacctaatattgttgggtatatgagagttctcttgaactgtgttgcttttgctgtgtgtttctccaacaagccacttttctctgtcctttatttcttcagcttttgttgtgatgctgtggatggctgggtggctcgtagattcaaccaagtttcaacatttggagctgttcttgacatggtcacagatagagttagcacagcttgtcttctcgtgattctctctcaaatctacaggcctagtttggtcttcctctcattgctggctttagatattgctagtcattggctgcagatgtacagtacgtttctagcagggaagagcagccataaggatgtgaaagacagcacaagctggctttttagactctactatggaaaccggatatttatgtgttactgctgtgtttcttgcgaggttctgtatatcatccttcttctcattgcaaagaaccaatctgaaaatctcctgaatgtcgtagttgctacattaacacagatttcaccactctcttttctcctggctttgacattgttcggttggtcgatgaagcagaccattaatgtcattcagatgaaaactgctgcagacgtttgtgtactgtatgatttagagaagcagcagaagccttgatcatcttcctttgtctcaacctgaaactcttttttttctttcatttttgttctcttttcactgtggatgtagataattgtttttaatgaaatgaagaaatattgatttgccttttgac

SEQ ID NO: 7391 - protein, 227 aa, Arabidopsis thaliana
  misc_feature (1)..(227): useful for making plants with modified plant phenotypes as described in USSN 12/139,269
  misc_feature (45)..(206): Pfam Name: CDP-OH_P_transf; Pfam Description: CDP-alcohol phosphatidyltransferase
  misc_feature (45)..(206): Pfam Name: CDP-OH_P_transf; Pfam Description: CDP-alcohol phosphatidyltransferase
  misc_feature (1)..(227): Utility: Useful for making plants sterile and for genetic confinement
MAKKERPRPEKLSVYLYIPNIVGYMRVLLNCVAFAVCFSNKPLFSVLYFFSFCCDAVDGWVARRFNQVSTFGAVLDMVTDRVSTACLLVILSQIYRPSLVFLSLLALDIASHWLQMYSTFLAGKSSHKDVKDSTSWLFRLYYGNRIFMCYCCVSCEVLYIILLLIAKNQSENLLNVVVATLTQISPLSFLLALTLFGWSMKQTINVIQMKTAADVCVLYDLEKQQKP

SEQ ID NO: 7392 - protein, 227 aa, Arabidopsis thaliana
  misc_feature (1)..(227): useful for making plants with modified plant phenotypes as described in USSN 12/139,269
  misc_feature (1)..(227): Public GI no. 21745398
  misc_feature (1)..(227): Utility: Useful for making plants sterile and for genetic confinement
MAKKERPRPEKLSVYLYIPNIVGYMRVLLNCVAFAVCFSNKTLFSLLYFFSFCCDAVDGWCARRFNQVSTFGAVLDMVTDRVSTACLLVVLSQVYRPSLVFLSLLALDIASHWLQMYSTFLAGKSSHKDVKDSTSWLFRLYYGNRIFMCYCCVSCEVLYIILLLIAKNQTENLLNVVVSTLTQISPLSLLLALTIFGWSMKQTVNIIQMKTAADVCVLYDIEKQQKP

SEQ ID NO: 7393 - protein, 225 aa, Arabidopsis thaliana
  misc_feature (1)..(225): useful for making plants with modified plant phenotypes as described in USSN 12/139,269
  misc_feature (1)..(225): Ceres CLONE ID no. 27810
  misc_feature (1)..(225): Utility: Useful for making plants sterile and for genetic confinement
MAKQRPATLSVYLYIPNIVGYMRVLLNCIAFSVCFSNKTLFSLLYFFSFCCDAVDGWCARKFNQVSTFGAVLDMVTDRVSTACLLVILSQIYRPSLVFLSLLALDIASHWLQMYSTFLSGKTSHKDVKDSTSWLFRLYYGNRMFMGYCCVSCEVLYIILLLIATNQTENLMNVVVKSLMQISPLSLLLALSIFGWSIKQIINVIQMKTAADVCVLYDIEKQHKKP

SEQ ID NO: 7394 - protein, 225 aa, Arabidopsis thaliana; identical to SEQ ID NO: 7393
  misc_feature (1)..(225): useful for making plants with modified plant phenotypes as described in USSN 12/139,269
  misc_feature (1)..(225): Public GI no. 21555401
  misc_feature (1)..(225): Utility: Useful for making plants sterile and for genetic confinement

SEQ ID NO: 7395 - protein, 225 aa, Arabidopsis thaliana
  misc_feature (1)..(225): useful for making plants with modified plant phenotypes as described in USSN 12/139,269
  misc_feature (1)..(225): Public GI no. 27311653
  misc_feature (1)..(225): Utility: Useful for making plants sterile and for genetic confinement
MAKQRPATLSVYLYIPNIVGYMRVLLNCIAFSVCFSNKTLFSLLYFFSFCCDAVDGWCARKFNQVSTFGAVLDMVTDRVSTACLLVILSQIYRPSLVFLSLLALDIASHWLQMYSTFLSGKTSHKDVKDSTSWLFRLYYGNRMFMGYSCVSCEVLYIILLLIATNQTENLMNVVVKSLMQISPLSLLLALSIFGWSIKQIINVIQMKTAADVCVLYDIEKQHKKP

SEQ ID NO: 7396 - protein, 227 aa, Glycine max
  misc_feature (1)..(227): useful for making plants with modified plant phenotypes as described in USSN 12/139,269
  misc_feature (1)..(227): Ceres CLONE ID no. 581207
  misc_feature (1)..(227): Utility: Useful for making plants sterile and for genetic confinement
MAKKPGPRSSKLSVYLYIPNIIGYIRVLLNCFAFSQCLSNKILFSILYFLSFVCDAVDGWCARKFNQVSTFGAVLDMVTDRISTACLLVVLSQLYKPGLSFLSLLALDIASHWLQMYSTFLTGKTSHKDVKDSSSWLFRAYYGNRMFMAYCCVSCEVLYLILFYLAENQTEKLVDVISSNLQKISFLSLLMGTSLFGWAVKQIINVIQMKTAADACVLYDIEKEHKN

SEQ ID NO: 7397 - protein, 218 aa, Zea mays
  misc_feature (1)..(218): useful for making plants with modified plant phenotypes as described in USSN 12/139,269
  misc_feature (1)..(218): Ceres CLONE ID no. 306792
  misc_feature (1)..(218): Utility: Useful for making plants sterile and for genetic confinement
MPSVYLYIPNIIGYFRIIINFIAFAVCYSNKALFAVLYFFSFVLDGVDGWFARKFNQASTFGAVLDMVTDRVSTACLLALLSQFYRPGLVFLILLGLDITSHWFQMYSSFLSGKTSHKDVKHTGNWLLKLYYGYRPFMAFCCVSCEVLYIILFLFADEKSTSLLSACKGLLNQSPIIILVFISTLVGWAVKQVTNVIQMKTAADACVVYDLKRSKRKA

SEQ ID NO: 7398 - protein, 218 aa, Zea mays; identical to SEQ ID NO: 7397
  misc_feature (1)..(218): useful for making plants with modified plant phenotypes as described in USSN 12/139,269
  misc_feature (1)..(218): Ceres CLONE ID no. 321760
  misc_feature (1)..(218): Utility: Useful for making plants sterile and for genetic confinement

SEQ ID NO: 7399 - protein, 215 aa, Zea mays
  misc_feature (1)..(215): useful for making plants with modified plant phenotypes as described in USSN 12/139,269
  misc_feature (1)..(215): Ceres CLONE ID no. 284101
  misc_feature (1)..(215): Utility: Useful for making plants sterile and for genetic confinement
MPSVYLYIPNIIGYFRIIINFIAFAVCYSNKALFAILYFISFVLDGVDGWFARKFNQASTFGAVLDMVTDRVSTACLLALLSQFYRPGLVFLILLGLDITSHWFQMYSSFLSGKTSHKDVKHTGNWLLKLYYGYRPFMAFCCVSCEVLYIFLFLFADEESTSLLSVCKGILNQSPVVILVFVSTLVGWAVKQATNVIQMKTAADACVVYDLKRSK

SEQ ID NO: 7400 - protein, 215 aa, Zea mays
  misc_feature (1)..(215): useful for making plants with modified plant phenotypes as described in USSN 12/139,269
  misc_feature (1)..(215): Public GI no. 34577127
  misc_feature (1)..(215): Utility: Useful for making plants sterile and for genetic confinement
MPSVYLYIPNIIGYFRIIINFIAFAVCYSNKALFAILYFISFVLDGVDGWFARKFNQASTFGAVLDMVTDRVSTACLLALLSQFYRPGLAFLILLGLDITSHWFQMYSSFLSGKTSHKDVKHTGNWLLKLYYGYRPFMAFCCVSCEVLYIFLFLFADEESTSLLSVCKGILNQSPVVILVFVSTLVGWAVKQATNVIQMKTAADACVVYDLKRSK

SEQ ID NO: 7401 - protein, 223 aa, Zea mays
  misc_feature (1)..(223): useful for making plants with modified plant phenotypes as described in USSN 12/139,269
  misc_feature (1)..(223): Public GI no. 50904897
  misc_feature (1)..(223): Utility: Useful for making plants sterile and for genetic confinement
MAQPSSKKTPSVYLYIPNIIGYFRIIINFIAFAVCYSNRVLFAILYFFSFFCDGLDGWFARKFNQASTFGAVLDMVTDRVSTACLLALLSQFYRPGLVFLMLLGLDITSHWFQMYSSFLSGKTSHKDVKDTGNWLLKLYYGHRPFMAFCCVASEVLYIVLFLFADEKSTSLLNVCGNLLKQSPLTVFVFISTLVGWALKQVINVIQMKSAADACVVFDLKRGK

SEQ ID NO: 7402 - protein, 223 aa, Zea mays
  misc_feature (1)..(223): useful for making plants with modified plant phenotypes as described in USSN 12/139,269
  misc_feature (1)..(223): Public GI no. 13661020
  misc_feature (1)..(223): Utility: Useful for making plants sterile and for genetic confinement
MAQPSSKKTPSVYLYIPNIIGYFRIIINFIAFAVCYSNRVLFAILYFFSFFCDGLDGWFARKFNQASTFGAVLDMVTDRVSTACLLALLSQFYRPGLVFLMLLGLDITSHWFQMYSSFLSGKTSHKDVKDTGNWLLKLYYGHRPFMAFCCVASEVLYIVLFLFADEKSTSLLNVCGNLLKQSPLTVFFFISTLVGWALKQVINVIQMKSAADACVVFDLKRGK

SEQ ID NO: 7403 - DNA, 1497 bp, Arabidopsis thaliana
  misc_feature (1)..(1497): useful for making plants with modified plant phenotypes as described in USSN 12/139,269
  misc_feature (1)..(1497): Ceres CLONE ID no. 38757
  misc_feature (1)..(1497): Also known as  Ceres CDNA ID no. 23556383
atctctctctctctctttttattttctttctttcttaattcatctaaactctctctgcttttgcttttcgtaattccttacatttcactcaatattaatccccagaatctccgatccacccacaaatttagcaattttctgagatttgatcatttgggtcaccaaaaaatcttgtctttttgatctgggtttaacgccaataatcatatgggaaacattagcagcagcggcggtgaaggtagacgccgtcgacggcgaaaccatacggcggctccaccaccacctcctcctcctccttcttcttctcttcctccaccacctctacctacagaaatccaagctaatcccatcgttttcgctgccgttactccctatcctaatcctaatcctaatccggtttaccagtaccctgcttcttactaccaccatcctcccccgggagccatgcctcttccgccgtacgaccaccacctccaacatcatccaccgcatccttaccacaaccactcttgggctcccgtggcgatggccagatacccttatgctggtcacatgatggctcaaccgactccttacgttgaacaccagaaagccgtcacgattcgtaacgacgttaatctcaagaaggagtctcttaggcttgaacccgacccggataatccgggtcgctttctcgtctcctttacgtttgatgcaaccgtctccggaaggattagtgtcattttctttgctaaagaatccgaagattgcaaactcacagcgacaaaggaagatatactgccacctatcactctagatttcgagaaaggacttggtcagaagtttaaacaatcatctggttctggtatagacttttcggtctttgaggacgttgagctgttcaaggcggccgcagacacagagatctatccattagcggttaaggcagaagcagctccctcaggtggtgagaatgaagaagaagaaaggtcggggtcgaagaatgcgcagattactcaagcggtttatgagaaggataaaggagagattaagattagagtggtgaagcagatactatgggttaatggaacgagatatgagttgcaggagatttatgggattgggaatacagttgagggggatgatgattcagctgatgatgctaatgatcctggtaaagaatgtgttatatgtttgtctgaaccacgagacaccactgttcttccatgtcgacatatgtgtatgtgtagcggatgtgctaaggtattgaggtttcagacaaatcgatgccccatttgcaggcaacctgttgaaaggcttttggagataaaagttcacggtaacaacggaagcgggaataacaccggacagggagaaacagttgaacaagagtagctaaacacggccgagtatggattgaaatgccatcgaaatattagtagtatatgcatgtttgatccttgtatgttaacaacaaaatgtgtgattgtcaattcataatatagagattacgaaacc

SEQ ID NO: 7404 - protein, 388 aa, Arabidopsis thaliana
  misc_feature (1)..(388): useful for making plants with modified plant phenotypes as described in USSN 12/139,269
  misc_feature (319)..(357): Pfam Name: zf-C3HC4; Pfam Description: Zinc finger, C3HC4 type (RING finger)
  misc_feature (319)..(357): Pfam Name: zf-C3HC4; Pfam Description: Zinc finger, C3HC4 type (RING finger)
  misc_feature (1)..(388): Utility: Useful for making plants sterile and for genetic confinement
  misc_feature (1)..(388): Utility: Useful for making plants with increased biomass and foliage
  misc_feature (1)..(388): Utility: Useful for making smaller plants
MGNISSSGGEGRRRRRRNHTAAPPPPPPPPSSSLPPPPLPTEIQANPIVFAAVTPYPNPNPNPVYQYPASYYHHPPPGAMPLPPYDHHLQHHPPHPYHNHSWAPVAMARYPYAGHMMAQPTPYVEHQKAVTIRNDVNLKKESLRLEPDPDNPGRFLVSFTFDATVSGRISVIFFAKESEDCKLTATKEDILPPITLDFEKGLGQKFKQSSGSGIDFSVFEDVELFKAAADTEIYPLAVKAEAAPSGGENEEEERSGSKNAQITQAVYEKDKGEIKIRVVKQILWVNGTRYELQEIYGIGNTVEGDDDSADDANDPGKECVICLSEPRDTTVLPCRHMCMCSGCAKVLRFQTNRCPICRQPVERLLEIKVHGNNGSGNNTGQGETVEQE

SEQ ID NO: 7405 - protein, 425 aa, Arabidopsis thaliana
  misc_feature (1)..(425): useful for making plants with modified plant phenotypes as described in USSN 12/139,269
  misc_feature (1)..(425): Public GI no. 31430853
  misc_feature (1)..(425): Utility: Useful for making plants sterile and for genetic confinement
  misc_feature (1)..(425): Utility: Useful for making plants with increased biomass and foliage
  misc_feature (1)..(425): Utility: Useful for making smaller plants
MGNMGSSGGHRRRNNGHGRHHHHGQPTAPPPPPQQQQQEVAPNRYVFAAASPYPPQYPNPNLPQYYPQYGNFYPPPPPSMPGPLPAPYDHHHRGGGPAQPPPPPPPPQPIHAAGEFPPAMLQQHPHYHGWGGNFSYGPPTQPPAPAPPYVEHQKAVTIRNDVNLKKETLRVEPDDECPGRFLITFTFDATVAGSMTVYFFAKEELNCNLTATKEDLLKPVTVTFKEGLGQKFRQPSGTGIDFSLFEDAELFKEGEMDVYPLAVKAETTFSIGQFSEGEEQKSQTPNSQITQAVFERKENGDYHVRVVKQILWVNGTRYELQEIYGIGNSVEGDTEGNDPGKECVICLSEPRDTTVLPCRHMCMCSECAKVLRYQTNRCPICRQPVERLLEIKVNNKGEEQQQQQIPQPPPPPSTAPPHQQQESQA

SEQ ID NO: 7406 - protein, 303 aa, Triticum aestivum
  misc_feature (1)..(303): useful for making plants with modified plant phenotypes as described in USSN 12/139,269
  misc_feature (1)..(303): Ceres CLONE ID no. 570295
  misc_feature (1)..(303): Utility: Useful for making plants sterile and for genetic confinement
  misc_feature (1)..(303): Utility: Useful for making plants with increased biomass and foliage
  misc_feature (1)..(303): Utility: Useful for making smaller plants
MGNAGSSGRPNLPPPRPHLHGVPPPYYHQYPPWRPGAAAPPPVPFPTHVERHRAVAVSAGVNVKGHTLRLERDDDGGGHLLAFSFDADAPGSITVYFFAQEADDSVLKGTKENLLKPVTVTFKEGHGQEFRQPSGTGIKLSMFEESELTKVGEDHVFPLALKVEVGVPSNQELGREHDAEDSKSLAKFAVFVKKDSAEYGINIVQQILWVNGTRYVLQEIYGIGNRNTADRNVNEDDSGKECVVCLTEPRDTTVLPCRHMCLCRECAQTLRFQTNKCPMCRQPVESLLEIKVDSTPRHQGGDQ

SEQ ID NO: 7407 - protein, 313 aa, Triticum aestivum
  misc_feature (1)..(313): useful for making plants with modified plant phenotypes as described in USSN 12/139,269
  misc_feature (1)..(313): Public GI no. 34914816
  misc_feature (1)..(313): Utility: Useful for making plants sterile and for genetic confinement
  misc_feature (1)..(313): Utility: Useful for making plants with increased biomass and foliage
  misc_feature (1)..(313): Utility: Useful for making smaller plants
MGNIASSGGASPRPPPPHLEAYRHGVPPPYYHSYPRPPPGAAAPPPVPVPAHVERHRAVAVSVGVNVKGDTLRLVPDDDDDDGRSLLLAFSFDADGPGSITVCFFAQEDKCALKTAKENLLQPVTVPFKEGRGQEFKQPSGSGIDVSRFEESELTNVGEGGVFPVAFKVQMDVSGNQESEGAHETEQSKYLVKYAIFVKKDNAEYGVHVVQQILWVNGIRYVLQEIYGIGNTADKNAHEDDSGKECVVCLSEPRDTAVLPCRHMCLCRECAQVLKYQTNKCPICRQPVEGLREIEVDNKPIPQQGSQQLTAPQ

SEQ ID NO: 7408 - DNA, 1707 bp, Arabidopsis thaliana
  misc_feature (1)..(1707): useful for making plants with modified plant phenotypes as described in USSN 12/139,269
  misc_feature (1)..(1707): Ceres CLONE ID no. 38785
  misc_feature (1)..(1707): Also known as  Ceres CDNA ID no. 23370076
gttgattataattagacttcttcatttactctctctctgacttaaaacatttattttttcttcttcttgttctctctctctttctctcatcactatgaagagtttcaacacagaagaacgcaaccactccacggcggaatccggcgatgcctacactgtgtcggacccgacaaagaacgtcgatgaagatggtcgagagaagcgtaccgggacgtggcttacggcgagtgcgcatattatcacggcggtgataggctccggagtgttgtctttagcatgggctatagctcagcttggttggatcgcagggacatcgattttgctcattttctcgttcattacttacttcacctccaccatgctcgccgattgctaccgtgcgccggatcccgtcaccggaaaacggaattacacttacatggacgttgttcgatcttacctcggtggtaggaaagtgcagctctgtggagtggcacaatatgggaatctgattggggtcactgttggttacaccatcactgcttctattagtttggtagcggtagggaaatcgaactgcttccacgataaagggcacactgcggattgtactatatcgaattatccgtatatggcggtttttggtatcattcaagttattcttagccagatcccaaatttccacaagctctcttttctttccattatggccgcagtcatgtcctttacttatgcaactattggaatcggtctagccatcgcaaccgtcgcaggtgggaaagtgggtaagacgagtatgacgggcacagcggttggagtagatgtaaccgcagctcaaaagatatggagatcgtttcaagcggttggggacatagcgttcgcctatgcttatgccacggttctcatcgagattcaggatacactaagatctagcccagctgagaacaaagccatgaaaagagcaagtcttgtgggagtatcaaccaccacttttttctacatcttatgtggatgcatcggctatgctgcatttggaaacaatgcccctggagatttcctcacagatttcgggtttttcgagcccttttggctcattgactttgcaaacgcttgcatcgctgtccaccttattggtgcctatcaggtgttcgcgcagccgatattccagtttgttgagaaaaaatgcaacagaaactatccagacaacaagttcatcacttctgaatattcagtaaacgtacctttccttggaaaattcaacattagcctcttcagattggtgtggaggacagcttatgtggttataaccactgttgtagctatgatattccctttcttcaacgcgatcttaggtcttatcggagcagcttccttctggcctttaacggtttatttccctgtggagatgcacattgcacaaaccaagattaagaagtactctgctagatggattgcgctgaaaacgatgtgctatgtttgcttgatcgtctcgctcttagctgcagccagatccatcgcaggacttataagtagtgtcaaaacctacaagcccttccggactatgcatgagtgagtttgagatcctcaagagagtcaaaaatatatgtagtagtttggtctttctgttaaactatctggtgtctaaatccaatgagaatgctttattgctaaaacttcatgaatctctctgtatctacatctttcaatctaatacatatgagctgttcc

SEQ ID NO: 7409 - protein, 485 aa, Arabidopsis thaliana
  misc_feature (1)..(485): useful for making plants with modified plant phenotypes as described in USSN 12/139,269
  misc_feature (37)..(472): Pfam Name: Aa_trans; Pfam Description: Transmembrane amino acid transporter protein
  misc_feature (37)..(472): Pfam Name: Aa_trans; Pfam Description: Transmembrane amino acid transporter protein
  misc_feature (1)..(485): Utility: Useful for making plants sterile and for genetic confinement
  misc_feature (1)..(485): Utility: Useful for making smaller plants
MKSFNTEERNHSTAESGDAYTVSDPTKNVDEDGREKRTGTWLTASAHIITAVIGSGVLSLAWAIAQLGWIAGTSILLIFSFITYFTSTMLADCYRAPDPVTGKRNYTYMDVVRSYLGGRKVQLCGVAQYGNLIGVTVGYTITASISLVAVGKSNCFHDKGHTADCTISNYPYMAVFGIIQVILSQIPNFHKLSFLSIMAAVMSFTYATIGIGLAIATVAGGKVGKTSMTGTAVGVDVTAAQKIWRSFQAVGDIAFAYAYATVLIEIQDTLRSSPAENKAMKRASLVGVSTTTFFYILCGCIGYAAFGNNAPGDFLTDFGFFEPFWLIDFANACIAVHLIGAYQVFAQPIFQFVEKKCNRNYPDNKFITSEYSVNVPFLGKFNISLFRLVWRTAYVVITTVVAMIFPFFNAILGLIGAASFWPLTVYFPVEMHIAQTKIKKYSARWIALKTMCYVCLIVSLLAAARSIAGLISSVKTYKPFRTMHE

SEQ ID NO: 7410 - protein, 464 aa, Brassica napus
  misc_feature (1)..(464): useful for making plants with modified plant phenotypes as described in USSN 12/139,269
  misc_feature (1)..(464): Ceres CLONE ID no. 1078352
  misc_feature (1)..(464): Utility: Useful for making plants sterile and for genetic confinement
  misc_feature (1)..(464): Utility: Useful for making smaller plants
MSDPTKNVDDDGREKRTGTWLTASAHIITAVIGSGVLSLAWAIAQLGWIAGTLILIIFSFITYFTSTMLADCYRAPDPLTGKRNYTYMDVVRSYLGGRKVQLCGVAQYGNLIGITVGYTITASISLVAIGKANCYHNKGHHADCTISNYPYMAAFGIIQILLSQIPNFHKLSFLSLMAAVMSFAYASIGIGLAIATVAGGKVGKTNMTGTVVGVDVTAAQKIWRSFQAVGDIAFAYAYATVLIEIQDTLRSSPAENKAMKRASFVGVSTTTFFYILCGCLGYAAFGNKAPGDFLTNFGFYEPFWLIDFANACIAFHLIGAYQVFAQPIFQFVEKKCNRNWPDNKFITSEYSVNIPFLGKFSINLFRLVWRTAYVVITTLVAMIFPFFNAILGLIGAASFWPLTVYFPVEMHIAQTKVKKYSSRWIGLKMLCWVCLIVSLLAAAGSIAGLISSVKTYKPFRTIHE

SEQ ID NO: 7411 - protein, 467 aa, Glycine max
  misc_feature (1)..(467): useful for making plants with modified plant phenotypes as described in USSN 12/139,269
  misc_feature (1)..(467): Ceres CLONE ID no. 479285
  misc_feature (1)..(467): Utility: Useful for making plants sterile and for genetic confinement
  misc_feature (1)..(467): Utility: Useful for making smaller plants
  misc_feature (53)..(53): Xaa is any aa, unknown or other
  misc_feature (62)..(62): Xaa is any aa, unknown or other
MHIETPETFADGSKNFDDDGRAKRTGTWITASAHIITAVIGSGVLSLAWAIAXMGWVAGPAXLFVFSLITYFTSTLLADCYRSPDPVHGKRNYTYSEVVKANLGGRKFQLCGLAQYINLVGVTIGYTITASLSMGAVKKSNCLHKHGHQDECKVKDNAFMIAFACIQILLSQIPNFHKLSWLSIVAAVMSFAYSSIGLGLSIAKIIGGGHVRTTLTGVEVSGTEKVWKMFQAIGDIAFAYAFSNVLIEIQDTLKSSPPENKVMKRASLIGIMTTTLFYVLCGCLGYAAFGNDAPSNFLTGFGFYEPFWLIDFANVCIAVHLVGAYQVFVQPIFGFVEKWSKENWTESQFINGEHTLNIPLCGSYNVNFFRVVWRTAYVIITAVVAMLLPFFNDFLALIGALSFWPLTVYFPIEMYIKKSNMQRFSFTWTWLKILSWVCLIISIISLVGSIQGLSVSIKKYKPFQAEQ

SEQ ID NO: 7412 - protein, 471 aa, Zea mays
  misc_feature (1)..(471): useful for making plants with modified plant phenotypes as described in USSN 12/139,269
  misc_feature (1)..(471): Ceres CLONE ID no. 264196
  misc_feature (1)..(471): Utility: Useful for making plants sterile and for genetic confinement
  misc_feature (1)..(471): Utility: Useful for making smaller plants
MVGAMRGGAMELEDRLATLPRFRGDHDDDGKERRTGTVWTATAHIITAVIGSGVLSLAWAMAQLGWVAGPLTLVLFAAITFYTCGLLADCYRVGDPVTGKRNYTYTEAVKSNLGGWYVWFCGFCQYVNMFGTGIGYTITASISAAAINKSNCFHWHGHDADCSQNTSAYIIGFGVVQVIFSQLHNFHKLWWLSIIAAIMSFSYSAIAVGLSLAQIVMGPTGKTTMTGTLVGVDVDAAQKVWMTFQALGNVAFAYSYAIILIEIQDTLRSPPAENKTMRRATMMGISTTTGFYMLCGCLGYAAFGNAASGNILTGFGFYEPFWLVDFANACIVVHLVGGFQVFCQPLFAAVEGAVAARYPGSTREYGAAGLNVFRLVWRTAFVAVITLLAILMPFFNSILGILGSIAFWPLTVFFPVEMYIRQRQVRRFSTKWIALQSLSFVCFLVTAASCAASVQGVVDSLKTYVPFKTRS

SEQ ID NO: 7413 - protein, 513 aa, Glycine max
  misc_feature (1)..(513): useful for making plants with modified plant phenotypes as described in USSN 12/139,269
  misc_feature (1)..(513): Ceres CLONE ID no. 512972
  misc_feature (1)..(513): Utility: Useful for making plants sterile and for genetic confinement
  misc_feature (1)..(513): Utility: Useful for making smaller plants
MLPRSRTLPSRIHQGIIEERHNVRHYLQVEVRPNNTQTETEAMNIQSNYSKCFDDDGRLKRTGTFWMATAHIITAVIGSGVLSLAWAVAQLGWVAGPIVMFLFAVVNLYTSNLLTQCYRTGDSVTGHRNYTYMEAVNSILGGKKVKLCGLIQYINLFGVAIGYTIAASVSMMAIKRSNCYHSSHGKDPCHMSSNGYMITFGIAEVIFSQIPDFDQVWWLSIVAAIMSFTYSSVGLSLGVAKVAENKSFKGSLMGISIGTVTQAGTVTSTQKIWRSLQALGAMAFAYSFSIILIEIQDTIKSPPAEHKTMRKATTLSIAVTTVFYLLCGCMGYAAFGDNAPGNLLTGFGFYNPYWLLDIANLAIVIHLVGAYQVFSQPLFAFVEKWSARKWPKSNFVTAEYDIPIPCFGVYQLNFFRLVWRTIFVLLTTLIAMLMPFFNDVVGILGAFGFWPLTVYFPIDMYISQKKIGRWTSRWLGLQLLSASCLIISLLAAVGSMAGVVLDLKTYKPFKTSY

SEQ ID NO: 7414 - DNA, 1263 bp, Arabidopsis thaliana
  misc_feature (1)..(1263): useful for making plants with modified plant phenotypes as described in USSN 12/139,269
  misc_feature (1)..(1263): Ceres CLONE ID no. 38843
  misc_feature (1)..(1263): Also known as  Ceres CDNA ID no. 23382940
atgaaataaaaagaagcatcttctagagagagacatattgagaaagagagagaaagctttagggtttcaaaaaaaaaaactgagaccctttagaaatctcctaacaggaaattttttctcaaacgctatagaaaatgggagtcataatcaatcaccatttcctcgcttttatcttcggcatcttaggaaacgtgatatccttccttgtattcctcgctccagtgccaactttttatagaatatacaagagaaaatcgacggaaagtttccagtcgctaccgtaccaagtgtcgctatttagctgcatgctatggctctactacgcattgattaagaaagacgcttttctcctaattaccatcaactcctttggctgcgtcgtggagactctctacatagccatgttcttcgcttacgccaccagggagaaaaggatatcggctatgaagttgttcatagcaatgaacgttgccttcttctcgttgattctaatggtaacacatttcgtggttaaaactcctcccctccaagtctctgtactcggctggatttgtgttgccatttctgtttctgttttcgctgcccctctaatgatcgtggctcgtgtgataaagacaaagagtgtggagtacatgcccttcacgctttctttcttcctcactataagcgccgttatgtggttcgcttatggtttattcctcaatgacatatgcatagcgattccaaacgtggtgggattcgtactagggctgttgcaaatggttttgtacttggtttacaggaactcaaatgagaaaccagagaagattaattcgtcagaagaacaacttaagagtattgtcgtgatgagtccgttaggtgtgtcggaagtgcacccagttgtgacggaatcggtggacccactctctgaagccgttcatcatgaggatctgtccaaagttactaaagtggaggagccgtcaattgaaaacggcaagtgctacgtggaggctactcgtcctgaaaccgtttgaagtatgtgaagctcaaaatattgctctctctctctctctctctttcactctctttctctcggctcgtcgggccggccaaaggaagaaattgtattatcggcggggtggtttgttaaatttccatttttgtttcgtatcttattgatgatgtactacttgcataaagttttgtgtttatttgaatatattatctttgtgtaagttgtaactagtgctctttggaaaatttgatataataaacctcaatagc

SEQ ID NO: 7415 - protein, 292 aa, Arabidopsis thaliana
  misc_feature (1)..(292): useful for making plants with modified plant phenotypes as described in USSN 12/139,269
  misc_feature (134)..(220): Pfam Name: MtN3_slv; Pfam Description: MtN3/saliva family
  misc_feature (1)..(292): Utility: Useful for making plants sterile and for genetic confinement
  misc_feature (1)..(292): Utility: Useful for making plants with increased biomass
  misc_feature (1)..(292): Utility: Useful for making plants with increased biomass and foliage
  misc_feature (1)..(292): Utility: Useful for making smaller plants
MGVIINHHFLAFIFGILGNVISFLVFLAPVPTFYRIYKRKSTESFQSLPYQVSLFSCMLWLYYALIKKDAFLLITINSFGCVVETLYIAMFFAYATREKRISAMKLFIAMNVAFFSLILMVTHFVVKTPPLQVSVLGWICVAISVSVFAAPLMIVARVIKTKSVEYMPFTLSFFLTISAVMWFAYGLFLNDICIAIPNVVGFVLGLLQMVLYLVYRNSNEKPEKINSSEEQLKSIVVMSPLGVSEVHPVVTESVDPLSEAVHHEDLSKVTKVEEPSIENGKCYVEATRPETV

SEQ ID NO: 7416 - protein, 281 aa, Zea mays
  misc_feature (1)..(281): useful for making plants with modified plant phenotypes as described in USSN 12/139,269
  misc_feature (1)..(281): Ceres CLONE ID no. 263281
  misc_feature (1)..(281): Utility: Useful for making plants sterile and for genetic confinement
  misc_feature (1)..(281): Utility: Useful for making plants with increased biomass
  misc_feature (1)..(281): Utility: Useful for making plants with increased biomass and foliage
  misc_feature (1)..(281): Utility: Useful for making smaller plants
MEHPWASVFGILGNIISFLVFLAPVPTFLRVYRKKSTEWFSSVPYVVALFSCTLWILYALVKTNSSPLLTINAFGCVVEAAYILLYLVYAPRGARLRALASFLLLDVAAFSLVAVVTVVLVAEPHRVRVLGSVCLAFSMAVFVAPLSVIFVVIRTKSAEFMPFTLSFFLTLSAVAWFLYGLFTKDPYVTLPNVGGFFFGCIQMVLYCCYRKRKPASVVLPTTTAAAAVAQQLEAEMELPLAAHQHQLAVAVLPTCAAPVLAELQKLEEAMGSPRKGGVKAI

SEQ ID NO: 7417 - protein, 280 aa, Triticum aestivum
  misc_feature (1)..(280): useful for making plants with modified plant phenotypes as described in USSN 12/139,269
  misc_feature (1)..(280): Ceres CLONE ID no. 918913
  misc_feature (1)..(280): Utility: Useful for making plants sterile and for genetic confinement
  misc_feature (1)..(280): Utility: Useful for making plants with increased biomass
  misc_feature (1)..(280): Utility: Useful for making plants with increased biomass and foliage
  misc_feature (1)..(280): Utility: Useful for making smaller plants
MAHPWASAFGILGNIISFLVFLAPTPTFLRVYRKKSTEGFSAVPYVVALFSCMLWIFYALVKTNSSPLLTINAFGCVVEGFYILLYVVYAPRHARHRALAFFLLLDVAAFALIVAVTVFLVPQPSRVKVLGSVCLAFSMAVFVAPLSVIFVVIKTKSAEYMPFSLSFFLTLSAVAWFFYGLFTKDIYVTLPNVGGFFFGVAQMTLYFCYRKPDTSALVLPTGIHDVSTEPAAQQEVELPEGTHPAVAMLTVSTLPMLAELQKMEQEISSPTPRKGYIKAF

SEQ ID NO: 7418 - protein, 299 aa, Zea mays
  misc_feature (1)..(299): useful for making plants with modified plant phenotypes as described in USSN 12/139,269
  misc_feature (1)..(299): Ceres CLONE ID no. 239640
  misc_feature (1)..(299): Utility: Useful for making plants sterile and for genetic confinement
  misc_feature (1)..(299): Utility: Useful for making plants with increased biomass
  misc_feature (1)..(299): Utility: Useful for making plants with increased biomass and foliage
  misc_feature (1)..(299): Utility: Useful for making smaller plants
MSLQHPWAFAFGLLGNVISFMTFLAPIPTFYRIYKSKSTEGFQSVPYVVALFSAMLWIFYALIKSNETFLITINAAGCVIETIYVVMYFVYAPKKAKLFTAKIMVLLNGGVFGVILLLTLLLFKGSKRVVLLGWICVGFSVSVFVAPLSIMRRVIQTKSVEYMPFSLSLSLTLSAVVWFLYGLLIKDKYVALPNILGFTFGVVQMVLYVLYMNKTPVAATAEGKDAGKLSSAADEHVLVNIAKLSPALPERSSGVHPVTQMAGVPVRSCAAEATAPAMLPNRDVVDVFVSRHSPAVHVA

SEQ ID NO: 7419 - protein, 271 aa, Triticum aestivum
  misc_feature (1)..(271): useful for making plants with modified plant phenotypes as described in USSN 12/139,269
  misc_feature (1)..(271): Ceres CLONE ID no. 798115
  misc_feature (1)..(271): Utility: Useful for making plants sterile and for genetic confinement
  misc_feature (1)..(271): Utility: Useful for making plants with increased biomass
  misc_feature (1)..(271): Utility: Useful for making plants with increased biomass and foliage
  misc_feature (1)..(271): Utility: Useful for making smaller plants
MTYLAPLPTFYRIYRSKSTQGFQSVPYVVALFSAMLWIYYALLKSDECLLITINSAGCVIETIYIIIYLTYAPKQAKLFTAKILLLLNVGVFGLILLLTLLLSEGEKRVVMLGWVCVGFSVSVFIAPLSVIRLVVRTRSVEFMPFSLSLSLTVSAVVWFLYGLLIKDKYVALPNILGFAFGVIQMGLYALYRNAMPSPAPKQVDDADAIKVPEHVIHIAKLGPAAAIELNTHNPMERGMPPPMEDNGLACASDMTKGGIDMVEKATRVEQV

SEQ ID NO: 7420 - protein, 293 aa, Zea mays
  misc_feature (1)..(293): useful for making plants with modified plant phenotypes as described in USSN 12/139,269
  misc_feature (1)..(293): Ceres CLONE ID no. 219950
  misc_feature (1)..(293): Utility: Useful for making plants sterile and for genetic confinement
  misc_feature (1)..(293): Utility: Useful for making plants with increased biomass
  misc_feature (1)..(293): Utility: Useful for making plants with increased biomass and foliage
  misc_feature (1)..(293): Utility: Useful for making smaller plants
MAGLSLLHPMAFAFGLLGNIISFMTYLAPLPTFYRIYKNKSTEGFQSVPYVVALFSAMLWIYYALLKSNELLLITINSAGCVIETLYIAMYLLYAPKKAKLFTAKILLLLNVGVFGLILLLTLLLSAGQRRVVVLGWVCVAFSVSVFVAPLSIIRQVVRTRSVEFMPFSLSLSLTVSAVVWFLYGLLIKDKYVALPNVIGFSFGVVQMGLYALYRNATPRVPAKDVADDASKDKAPGEHVVVTIAKLTAATTAPAAAVAEDLVKVHDGHPEEAAKGAAKPAENGAGRSDAEQV

SEQ ID NO: 7421 - DNA, 660 bp, Arabidopsis thaliana
  misc_feature (1)..(660): useful for making plants with modified plant phenotypes as described in USSN 12/139,269
  misc_feature (1)..(660): Ceres CLONE ID no. 39127
  misc_feature (1)..(660): Also known as  Ceres CDNA ID no. 23356669
gcatctctgatctttcttggtgagagtaatagacatgggagctcttgattctctttccgagtatatctccgactacttccgcgtcaccagaaaaaggaggaagcggaaagtcatgcagacggtgaatataaaggtgaaaatggactgcgatggttgtgaacgcagagtcaagaacgcggtttcctccatgaaaggtgtgaaatcggtggaggtgaatagaaagatacataaagtgacggtgagtggatacgtggaaccaaagaaggtattaaagagaatcgaaaggacagggaaaaaagcggagatatggccgtacgttccttacaacatggtcgcatatccatacgcggtcggaacttacgacaaaaaagctccggccggttatgtcaggaaatctgagcagtcgcagttgcagctgttgccgggagctcccgagaaccactacatttctctttttagcgacgagaatcccaacgcttgcaccgttatgtaataaataatttactctagtagtattatccacagcatgtaacgtttttatcaagcaattggctctctctctctctctctttttgttatgttaatgcagagaggaagaaccaactatagctagttgtgtaaaattttcaatatttcaaaataagttagtggaatgtgtac

SEQ ID NO: 7422 - protein, 152 aa, Arabidopsis thaliana
  misc_feature (1)..(152): useful for making plants with modified plant phenotypes as described in USSN 12/139,269
  misc_feature (31)..(91): Pfam Name: HMA; Pfam Description: Heavy-metal-associated domain
  misc_feature (31)..(91): Pfam Name: HMA; Pfam Description: Heavy-metal-associated domain
  misc_feature (1)..(152): Utility: Useful for making plants sterile and for genetic confinement
MGALDSLSEYISDYFRVTRKRRKRKVMQTVNIKVKMDCDGCERRVKNAVSSMKGVKSVEVNRKIHKVTVSGYVEPKKVLKRIERTGKKAEIWPYVPYNMVAYPYAVGTYDKKAPAGYVRKSEQSQLQLLPGAPENHYISLFSDENPNACTVM

SEQ ID NO: 7423 - protein, 124 aa, Glycine max
  misc_feature (1)..(124): useful for making plants with modified plant phenotypes as described in USSN 12/139,269
  misc_feature (1)..(124): Ceres CLONE ID no. 656297
  misc_feature (1)..(124): Utility: Useful for making plants sterile and for genetic confinement
MQTVEIKVKMDCDGCERRVRNSVSNMSGVKQVEVNRKQSRVTVTGYVDRNKVLKKVQSTGKRAEFWPYIQYNLVAYPYVAQAYDKKAPSGYVKNTEQALPNPNAPDEKLTSLFSDDNPNACSIM

SEQ ID NO: 7424 - protein, 162 aa, Triticum aestivum
  misc_feature (1)..(162): useful for making plants with modified plant phenotypes as described in USSN 12/139,269
  misc_feature (1)..(162): Ceres CLONE ID no. 769994
  misc_feature (1)..(162): Utility: Useful for making plants sterile and for genetic confinement
  misc_feature (76)..(76): Xaa is any aa, unknown or other
MGVGGTLEYLSGLLGGGGGHGHGHGYGNRRRRKQMQTVELKVSMDCEGCERKVKNALSSMKGVRSVNINRKQQKVXVAGYVEPSKVLRKAQSTGKKAEIWPYVPYSQVSQPYVAGTYDKRAPAGYVRSQEPGYGNVSGQVSRQDDQLTDMFNDDNANSCAVM

SEQ ID NO: 7425 - protein, 115 aa, Zea mays
  misc_feature (1)..(115): useful for making plants with modified plant phenotypes as described in USSN 12/139,269
  misc_feature (1)..(115): Ceres CLONE ID no. 493668
  misc_feature (1)..(115): Utility: Useful for making plants sterile and for genetic confinement
MDCEGCERRVKSAVKSMRVVTSVAVNAKQSKCTVTGNVEPAKVLERVKATGKNAEMWPYVPYALTTYPYVGGAYDKKAPAGFVRSAPQAMADPGAPELKYMNMFNDDNVDACTVM

SEQ ID NO: 7426 - protein, 124 aa, Parthenium argentatum
  misc_feature (1)..(124): useful for making plants with modified plant phenotypes as described in USSN 12/139,269
  misc_feature (1)..(124): Ceres CLONE ID no. 1608079
  misc_feature (1)..(124): Utility: Useful for making plants sterile and for genetic confinement
METVEIKVKMDCDGCERRVKNAASSLKGVKSVDVNRKQNRVTVKGYVEPKKVLKKVQNTGKKAEMWPYVPVSITSYPYAPQAYDKKAPAGYVKNVPQAFHAPNSPTERYDDLFSDENPNACSVM

SEQ ID NO: 7427 - DNA, 565 bp, Arabidopsis thaliana
  misc_feature (1)..(565): useful for making plants with modified plant phenotypes as described in USSN 12/139,269
  misc_feature (1)..(565): Ceres CLONE ID no. 95855
  misc_feature (1)..(565): Also known as  Ceres CDNA ID no. 23364939
  misc_feature (550)..(550): k is g or t/u
acaaacaagcattttagagagacaaaacttaagtaaaaaaaaaaaactaattgagaaaatatggagaccgtgacatcacttgtcttcattgttaacttacttatcatttttacatcagttgtgaatcaggctagaggagatacatgtatagatggattaggctattgcaacaattgtgacgagagatgcaaggccaagcacggaccatcgagcgaaagcagctgtgatcgtagtgttggggtgccgctgtgcaaatgctactacgaatgtgaatctccgccatcaccacccgcgcagccgaagaaatgcgacggtggggctggtatatgtagtcaaagatgtcaaggacaatgttgtgatatgaactgtgcacaaaagtatattggtggacatggattttgtaatactcttggtacgtttagtttctgccaatgcgaatatccttgttaaagtcggttgacaaaactgtacaccaattattttttattattattttaatttcagcaatgcaataataaattaagaacaattactattaataataatatgkggacgacgtacttac

SEQ ID NO: 7428 - protein, 129 aa, Arabidopsis thaliana
  misc_feature (1)..(129): useful for making plants with modified plant phenotypes as described in USSN 12/139,269
  misc_feature (1)..(129): Utility: Useful for making plants sterile and for genetic confinement
  misc_feature (1)..(129): Utility: Useful for making smaller plants
  misc_feature (1)..(129): Utility: Useful for making stronger plants
METVTSLVFIVNLLIIFTSVVNQARGDTCIDGLGYCNNCDERCKAKHGPSSESSCDRSVGVPLCKCYYECESPPSPPAQPKKCDGGAGICSQRCQGQCCDMNCAQKYIGGHGFCNTLGTFSFCQCEYPC

SEQ ID NO: 7429 - protein, 127 aa, Arabidopsis thaliana
  misc_feature (1)..(127): useful for making plants with modified plant phenotypes as described in USSN 12/139,269
  misc_feature (1)..(127): Public GI no. 46396244
  misc_feature (1)..(127): Utility: Useful for making plants sterile and for genetic confinement
  misc_feature (1)..(127): Utility: Useful for making smaller plants
  misc_feature (1)..(127): Utility: Useful for making stronger plants
MERITSLVFFASFLIIFVSGVNQTRADSCDESLGLCETCDERCQAKHGPSCISKCDGEVGMLSCTCTYECGPPLPPKGNVCSGGTGMCSGKCPYKCCDTSCAQKYNGGRGFCNSFGNYNFCQCEYPC

SEQ ID NO: 7430 - protein, 104 aa, Glycine max
  misc_feature (1)..(104): useful for making plants with modified plant phenotypes as described in USSN 12/139,269
  misc_feature (1)..(104): Ceres CLONE ID no. 1041952
  misc_feature (1)..(104): Utility: Useful for making plants sterile and for genetic confinement
  misc_feature (1)..(104): Utility: Useful for making smaller plants
  misc_feature (1)..(104): Utility: Useful for making stronger plants
MGLCDERITSSECDLRCKSHYNDGEGHCDNMNICNCIHHCVSPQPNKDTEPIRKCTSGLGLCSIDHCYDDCCNSKCAKQFKEGIGHCEIVGSMGTILCTCDYVC

SEQ ID NO: 7431 - DNA, 599 bp, Arabidopsis thaliana
  misc_feature (1)..(599): useful for making plants with modified plant phenotypes as described in USSN 12/139,269
  misc_feature (1)..(599): Ceres CLONE ID no. 99763
  misc_feature (1)..(599): Also known as  Ceres CDNA ID no. 23389588
agagaagaagaagatgtcgatgattccgatcagcaatcgccggagactatctccccggcgatagaatctgggaaccatttgaactcatgaacacctttcttgatttcccatcaccagctctctttctttctcaccactttccctcactttctcgagaaatattcccacaaacttcatcatccaccgtcaatacgcagctcaattggaccgagactccgacggctcacgttttcaaagcgtatcttccgggagtggatcaagacgaagtgattgcgttcgtagatgaagaaggatatcttcagatctgtactggcgacaacaagttcatgagcagatttaagcttcctaacaacgccttgacggatcaggtcacggcgtggatggaggacgagtttcttgtcgtgttcgttgagaaagatgcttcttcgtcgccgccacagctgccggagattgaggagaatcgtaacgtgagagttgtggaaatcaccggcgatgatgattaattaagtgttacatgttgtcgagatatatgtgaattaaagggaaacttaaaagtttagtgtactaaatgaacaagttaatcgcttgtttaggttgtg

SEQ ID NO: 7432 - protein, 162 aa, Arabidopsis thaliana
  misc_feature (1)..(162): useful for making plants with modified plant phenotypes as described in USSN 12/139,269
  misc_feature (1)..(162): Utility: Useful for making plants sterile and for genetic confinement
MSMIPISNRRRLSPGDRIWEPFELMNTFLDFPSPALFLSHHFPSLSREIFPQTSSSTVNTQLNWTETPTAHVFKAYLPGVDQDEVIAFVDEEGYLQICTGDNKFMSRFKLPNNALTDQVTAWMEDEFLVVFVEKDASSSPPQLPEIEENRNVRVVEITGDDD

SEQ ID NO: 7433 - protein, 134 aa, Brassica napus
  misc_feature (1)..(134): useful for making plants with modified plant phenotypes as described in USSN 12/139,269
  misc_feature (1)..(134): Ceres CLONE ID no. 975383
  misc_feature (1)..(134): Utility: Useful for making plants sterile and for genetic confinement
MNTFFDFPSPSLLLSRHFPSLSPFSSPSTVETQLNWTETPTAHVFKAYLPGTTQDEAIVFVDDEGYLQICAGDNKFMSRFKLPDNALKDQVTAWMEEDGFLVVFVAKDGAFSQTPPEIEDNRNVRVVEITGDDD

SEQ ID NO: 7434 - protein, 160 aa, Brassica napus
  misc_feature (1)..(160): useful for making plants with modified plant phenotypes as described in USSN 12/139,269
  misc_feature (1)..(160): Public GI no. 6969974
  misc_feature (1)..(160): Utility: Useful for making plants sterile and for genetic confinement
MSLIPNSRRGSSSVFDPFSLNLWDPFKDFPFPSSSSLSAFPEFSRENSAFVNTRVDWKETPEAHVFKADVPGLKKEEVKVEVEDDRVLKISGERNVEEEDKNDKWYRVERSSGKFLRRFQLPENAKVDQIKAAMENGVLSVTVPKAELKNVDVRAIEISG

SEQ ID NO: 7435 - protein, 148 aa, Glycine max
  misc_feature (1)..(148): useful for making plants with modified plant phenotypes as described in USSN 12/139,269
  misc_feature (1)..(148): Ceres CLONE ID no. 556334
  misc_feature (1)..(148): Utility: Useful for making plants sterile and for genetic confinement
MSIVPINQGDANGSNPFASWGQFVDFPLPPSISGFFPGLEFGFGFGSSVNTRVDWRETPRAHVWKLVLPGFSNEDVLVELQDERVLQVSVESGNFVTRFKVPDNGNLEQLKANMRHGVLVVTVPKFHQPTTTAPANRNVREVEIEGTD

SEQ ID NO: 7436 - protein, 158 aa, Glycine max
  misc_feature (1)..(158): useful for making plants with modified plant phenotypes as described in USSN 12/139,269
  misc_feature (1)..(158): Public GI no. 25809052
  misc_feature (1)..(158): Utility: Useful for making plants sterile and for genetic confinement
MSLIPSFFGNRRSNVYDPFSLDVWDPLKDFPFPSSALSASFPRENSAFVSTRVDWKETPEAHVFKADLPGLKKEEVKVEVEDDRVLQISGERSVEKEDKNDEWHRVERSSGKFLRRFRLPENAKMGQVKASMENGVLTVTVPKEEIKKPDVKSIEISG

SEQ ID NO: 7437 - protein, 158 aa, Zea mays
  misc_feature (1)..(158): useful for making plants with modified plant phenotypes as described in USSN 12/139,269
  misc_feature (1)..(158): Ceres CLONE ID no. 247046
  misc_feature (1)..(158): Utility: Useful for making plants sterile and for genetic confinement
MSLIRRSNVFDPFSLDLWDPFEGFPFGSGNSSSLFPSFPRTSSETAAFAGARIDWKETPEAHVFKADVPGLKKEEVKVEVEDGNVLQISGERNKEQEEKTDTWHRVERSSGRFLRRFRLPENAKTEQITAAMENGVLTVTVPKEDAKKPEVKSIQISG

SEQ ID NO: 7438 - protein, 156 aa, Zea mays
  misc_feature (1)..(156): useful for making plants with modified plant phenotypes as described in USSN 12/139,269
  misc_feature (1)..(156): Public GI no. 25044839
  misc_feature (1)..(156): Utility: Useful for making plants sterile and for genetic confinement
MSLVRRSNIFDPFSLDLWEPFEGFPFGGALSFPRPSASFPAETASFAGARIDWKETPEAHVFKADLPGVKKEEVKVEVEEGNVLQISGERTREKEEKNDTWHRVERSSGKFLRRFRLPDNAKVDQVKAAMENGVLTVTVPKEDVKKPQVKSVQISG

SEQ ID NO: 7439 - protein, 153 aa, Parthenium argentatum
  misc_feature (1)..(153): useful for making plants with modified plant phenotypes as described in USSN 12/139,269
  misc_feature (1)..(153): Ceres CLONE ID no. 1608166
  misc_feature (1)..(153): Utility: Useful for making plants sterile and for genetic confinement
MSIIPSFFGRRRSNVFDPFSLDVWDPFEGFPFNNNFGSLSDQVRSSETSSFVNANIDWKETADAHVFKADVPGLKKEEVKVEVEDDRVLQISGESNKESEEKGDTWHRVERSSGRFMRRFRLPENAKVDQVKAAMENGVLTVTVPKVDFKSLM

SEQ ID NO: 7440 - protein, 155 aa, Parthenium argentatum; identical to SEQ ID NO: 6218
  misc_feature (1)..(155): useful for making plants with modified plant phenotypes as described in USSN 12/139,269
  misc_feature (1)..(155): Public GI no. 56606538
  misc_feature (1)..(155): Utility: Useful for making plants sterile and for genetic confinement

SEQ ID NO: 7441 - DNA, 635 bp, Arabidopsis thaliana
  misc_feature (1)..(635): useful for making plants with modified plant phenotypes as described in USSN 12/139,269
  misc_feature (1)..(635): Ceres CLONE ID no. 106135
  misc_feature (1)..(635): Also known as  Ceres CDNA ID no. 23385352
aggttagttttttttcagcaatctctctctcgttgaatttcttcaaattgcagaagatttatccaatcttatttcgagtatattcaaaccttaatttcaacgctagtgaaaagtataagaggaagaagacagaagacatgcttactcgctgcgacgcggtagtagaggcggtttccggcgccgggaatgtaaccagtgcggtgatcgggagattctggtttatttttgtttgttgttgctgaattgggtgtaccgtaccggtttaattctgaaccggtggaaattccggtttagtccaaggaaaattttggataaactatggtttgttgggaatttagtcatccgatctatagttctctttcgctccttctggattgatcagagtttagttgatttgcttgaagaagatgaagttatgattgaagatgagctccgaccgtcgcagaggtgaaatgctgctgcccaaactaattactattgggccatttttaggcccatcaaaataagactgtcaatatgtaattttcacaaagtaaaaaacaatccttttatgtcttttggaagtgagatttaaattgggtatgtaatttttcagcgtaacaaaaacgacaaaaaaaaaataatcatgttatttt

SEQ ID NO: 7442 - protein, 34 aa, Arabidopsis thaliana
  misc_feature (1)..(34): useful for making plants with modified plant phenotypes as described in USSN 12/139,269
  misc_feature (1)..(34): Utility: Useful for making plants sterile and for genetic confinement
  misc_feature (1)..(34): Utility: Useful for making smaller plants
MLTRCDAVVEAVSGAGNVTSAVIGRFWFIFVCCC

SEQ ID NO: 7443 - DNA, 992 bp, Arabidopsis thaliana
  misc_feature (1)..(992): useful for making plants with modified plant phenotypes as described in USSN 12/139,269
  misc_feature (1)..(992): Ceres CLONE ID no. 267657
  misc_feature (1)..(992): Also known as  Ceres CDNA ID no. 23383683
atcaagatcgatccctctctaaaaatggctcaacaacactcttttctcctcttatgcttcttcctctcaatctcttatttactatcttccgcccaaaccgaagccacctcaatcgagagattagtgccaagagacctctacaacaaaattttcatccacaaggacaataccgcttgtcccgcaaatggtttctatacttacgaatcatttgtccaagcgacgaggcggtttccgagattcgggagcgtaggaagccccgtgacacaacgactcgaagtggctgcatttttggctcagatttcacacgagacgaccggaggatgggcaacggcaccagacggaccgtacgcttggggattatgctttaaagaagaagtgagtccacaaagcacttattgtgattcttctaatacacagtggccttgtttccctaacaagacttatcaaggaagaggtccaattcaactatcgtggaactacaactacggaccggccggtcgagccttaggattcgacggtctaaggaatccagaaacggtgtcaaataattcagtgatagcttttcaaacagcactttggttttggatgacgccacagagtcccaaaccttcgtgccatgacgtcatgatcggaaaataccgacctacggcggcggatttggcagctaaccggaccggcgggtttggtttaaccacaaatataataaatggcggtttagagtgtgggattcctggagacggacgggtcaatgaccgaatcgggttttttcagagatatactgggctgtttaaagtagcaactgggccgaatttggactgtgaaaatcaaaggccttatgcttaaacaattaatttggttgacccgaaatatgtatgtttataaacaaaaagtcaacatgtatgtttatggcattgcccacacatgggagccataaaaggggtttatattcaataatgtaattcaatttaatgtgatttgatggttttaattcc

SEQ ID NO: 7444 - protein, 272 aa, Arabidopsis thaliana
  misc_feature (1)..(272): useful for making plants with modified plant phenotypes as described in USSN 12/139,269
  misc_feature (33)..(265): Pfam Name: Glyco_hydro_19; Pfam Description: Chitinase class I
  misc_feature (1)..(272): Utility: Useful for making plants sterile and for genetic confinement
  misc_feature (1)..(272): Utility: Useful for making plants with increased biomass and foliage
  misc_feature (1)..(272): Utility: Useful for making smaller plants
  misc_feature (1)..(272): Utility: Useful for making stronger plants
MAQQHSFLLLCFFLSISYLLSSAQTEATSIERLVPRDLYNKIFIHKDNTACPANGFYTYESFVQATRRFPRFGSVGSPVTQRLEVAAFLAQISHETTGGWATAPDGPYAWGLCFKEEVSPQSTYCDSSNTQWPCFPNKTYQGRGPIQLSWNYNYGPAGRALGFDGLRNPETVSNNSVIAFQTALWFWMTPQSPKPSCHDVMIGKYRPTAADLAANRTGGFGLTTNIINGGLECGIPGDGRVNDRIGFFQRYTGLFKVATGPNLDCENQRPYA

SEQ ID NO: 7445 - protein, 277 aa, Glycine max
  misc_feature (1)..(277): useful for making plants with modified plant phenotypes as described in USSN 12/139,269
  misc_feature (1)..(277): Ceres CLONE ID no. 719679
  misc_feature (1)..(277): Utility: Useful for making plants sterile and for genetic confinement
  misc_feature (1)..(277): Utility: Useful for making plants with increased biomass and foliage
  misc_feature (1)..(277): Utility: Useful for making smaller plants
  misc_feature (1)..(277): Utility: Useful for making stronger plants
MTSSVPLVSTLLLCSIALLYSASFGAEAWTSPYIPVSSLISKSLYDTFFLHKDDTACPAKDFYPYDAFIRASKSFPAFGTTGCLATRKREIAAFLAQISHETTGGWATAPDGPFAWGLCFKEEISPQSNYCDSTNTQWPCFPGKSYKGRGPIQLSWNYNYGPAGKALGFDGLRNPEIVANNSVIAFKTAMWFWMTEQKPKPSCHNVMVGIYVPTEDDIAANRTAGYGLVTNIINGGLECGIPGDARVNDRIGFFERYTKLFNVDTGPNLDCAYQKPF

SEQ ID NO: 7446 - DNA, 837 bp, Glycine max
  misc_feature (1)..(837): useful for making plants with modified plant phenotypes as described in USSN 12/139,269
  misc_feature (1)..(837): Ceres CLONE ID no. 545208
  misc_feature (1)..(837): Also known as  Ceres CDNA ID no. 23694565
gaaagaaaagaactaagaagctgaaaaacaagagagagaaaaagaatagcacactcaaccatagttatctagaaccaaatcatgtctcacatagccgtcgagaggaacaggagaagacagatgaatgaacatctcaaagttttaagatctttgaccccatgtttctatatcaaaaggggagatcaagcatctataatagggggtgttatagaattcatcaaggagctacaccaagttcttcaagctttggagtcccagaaaagaagaaagagtttgagccctagccctggcccgagcccacgaacacttcagccaatgtttcatcaacttgatagcccctccatgattgggaccaattctttcaaggaactaggagcaagctgcaactctcctgttgcggatgttgaagtgaaaatctcgggttcatatgtgatcttgaaagtcatttgccacagaattccaggtcaagttgcaaagatcataactgttttggagagtctttcgtttgaagttcttcatctgaatatcagcagcatggaggagactgtcctttaccaatttgttgtcaagatagagctgggatgccaactaagtctggaggaactagcaatggaagtgcaacaaagcttctgcttagatgctataattgcgctgtgaagatgtagtatttctaaagagacccaatttcgaatcgtttgttaataaaagaatggcatgtgatagacatgcataaaaactatttcttcagtaattacttgctacaaactaggcttattatatcattactgttgtcataaacttgatgacaaggaaaatatgctgttgcttaatatttgg

SEQ ID NO: 7447 - protein, 191 aa, Glycine max
  misc_feature (1)..(191): useful for making plants with modified plant phenotypes as described in USSN 12/139,269
  misc_feature (1)..(50): Pfam Name: HLH; Pfam Description: Helix-loop-helix DNA-binding domain
  misc_feature (1)..(191): Utility: Useful for making plants sterile and for genetic confinement
MSHIAVERNRRRQMNEHLKVLRSLTPCFYIKRGDQASIIGGVIEFIKELHQVLQALESQKRRKSLSPSPGPSPRTLQPMFHQLDSPSMIGTNSFKELGASCNSPVADVEVKISGSYVILKVICHRIPGQVAKIITVLESLSFEVLHLNISSMEETVLYQFVVKIELGCQLSLEELAMEVQQSFCLDAIIAL

SEQ ID NO: 7448 - protein, 202 aa, Glycine max
  misc_feature (1)..(202): useful for making plants with modified plant phenotypes as described in USSN 12/139,269
  misc_feature (1)..(202): Public GI no. 6862916
  misc_feature (1)..(202): Utility: Useful for making plants sterile and for genetic confinement
MSHIAVERNRRRQMNEHLKSLRSLTPCFYIKRGDQASIIGGVIEFIKELQQLVQVLESKKRRKTLNRPSFPYDHQTIEPSSLGAATTRVPFSRIENVMTTSTFKEVGACCNSPHANVEAKISGSNVVLRVVSRRIVGQLVKIISVLEKLSFQVLHLNISSMEETVLYFFVVKIGLECHLSLEELTLEVQKSFVSDEVIVSTN

SEQ ID NO: 7449 - protein, 206 aa, Zea mays
  misc_feature (1)..(206): useful for making plants with modified plant phenotypes as described in USSN 12/139,269
  misc_feature (1)..(206): Ceres CLONE ID no. 336092
  misc_feature (1)..(206): Utility: Useful for making plants sterile and for genetic confinement
MNEHLKVLRSLTPGLYIKRGDQASIIGGAIEFIKELQQVLESLEARKKRRSSGGGHSFLTGSPSPTPSPRSHLLSSVSTPSPPVMIKELAACCNSAVADVEAKISGSNVLLRTLSRRSSIPGGQAVRLIAVLEGLHLEVLHLNISTMEDTVLHSLVLKIGLECQLSVEDLAYEVQQIFGQDTAEQKPQAEENHHHLIYSSAMAAAI

SEQ ID NO: 7450 - protein, 227 aa, Zea mays
  misc_feature (1)..(227): useful for making plants with modified plant phenotypes as described in USSN 12/139,269
  misc_feature (1)..(227): Public GI no. 57900676
  misc_feature (1)..(227): Utility: Useful for making plants sterile and for genetic confinement
MSHIAVERNRRRQMNDHLKVLRSLTPAFYIKRGDQASIIGGAIDFIKELQTLLQSLEAQKKRRQQPQAHLISPASISASGGGSPSPTPSPRSLITSCSPTAAAGSSAGSSSSISPKDENKQQLQLVAELAACCNSPMADVEARISGANVLLRTLSRRAPPVRIIALLESLHLEVLHLNITTMDDTVLYSFVLKIGLDCHLSVDDLAMEVHQSFMPPPAAHPDNHLHS

SEQ ID NO: 7451 - DNA, 1336 bp, Glycine max
  misc_feature (1)..(1336): useful for making plants with modified plant phenotypes as described in USSN 12/139,269
  misc_feature (1)..(1336): Ceres CLONE ID no. 546490
  misc_feature (1)..(1336): Also known as  Ceres CDNA ID no. 23694311
  misc_feature (1093)..(1093): y is t/u or c
  misc_feature (1094)..(1094): y is t/u or c
  misc_feature (1095)..(1095): y is t/u or c
atattaggatttgctttaaaatttttcaataaatcctatttatgatttcttctcaaaaccttgcaaacatcttggaggtgcttagttacttgatctttgggctagtattagtgagcattcttcatccactatcacaaatcagattcaaaatctattatcacaataatgaaaagaataaaaagagaataatgcaatgtcctcacataaaaaaaggaatatttttgccaacgatatatttattgagtggaactcttcaagcgatttttgggaaattttcaaagttacatgatgcaaatattcatttcaaagaagaacatttagaacttccttgtggtggaattgttggaatgtattgggcttcacagttggtggagacagagtctgctaaagcaaaggcgaaaaaagttgtagtaattatggtacctggattgacagcctctttcaaagaaccttatattcgaaatatatcgagtgaagctttagagaatggttataaggtggtgatttatcataatcgaggcaatcaagtagcattaactcttccaaaagaagggtatttggattattcaatagatctcaaatatgctgttgattatgttgtcaagacatatcctgatcatcaaatatttgctgttggacattcccttggtgcaaataatctcgtaaattatttggccaaatataaggatgattgtccgataaaagttgctgcttcggtttcaaatccttttgattttcacaaagcaggagaaggtgtcaaggatactatgtttgatggatttcttgctcaaatgatgcaaaattgggctcgaagaaatcaagatgtattactgaatgctccaaaatatcttgatatcaaatatgaattggcaatgcaagcaaagacattgagaggttttgatgaacagattactcgtagattatatggatatcctcattataatgattattatactggaatttcaagtgtttttaatattaaggatattaatataccattgctttgtttgaattctaaagatgatcctgttctaaatcatggaagtatctgtattgaagaatgtcaaaagaatgagaatattattttgattgyyyacacacaatggtggtcatgttggatggttccatgggattttacaaccgaaaaggtggtatcctaagcctgtcattgaatatttgaacacttgttttgaagaactacaggaagagggattacataagaaatagattttgattttttaaatgaaaaaagatttacattacatttattacaatatatacgaagggattttcttaccttgctatgatttttatttttatttgaaaaatggtttat

SEQ ID NO: 7452 - protein, 394 aa, Glycine max
  misc_feature (1)..(394): useful for making plants with modified plant phenotypes as described in USSN 12/139,269
  misc_feature (151)..(330): Pfam Name: Abhydrolase_1; Pfam Description: alpha/beta hydrolase fold
  misc_feature (1)..(394): Utility: Useful for making plants sterile and for genetic confinement
MISSQNLANILEVLSYLIFGLVLVSILHPLSQIRFKIYYHNNEKNKKRIMQCPHIKKGIFLPTIYLLSGTLQAIFGKFSKLHDANIHFKEEHLELPCGGIVGMYWASQLVETESAKAKAKKVVVIMVPGLTASFKEPYIRNISSEALENGYKVVIYHNRGNQVALTLPKEGYLDYSIDLKYAVDYVVKTYPDHQIFAVGHSLGANNLVNYLAKYKDDCPIKVAASVSNPFDFHKAGEGVKDTMFDGFLAQMMQNWARRNQDVLLNAPKYLDIKYELAMQAKTLRGFDEQITRRLYGYPHYNDYYTGISSVFNIKDINIPLLCLNSKDDPVLNHGSICIEECQKNENIILIVTHNGGHVGWFHGILQPKRWYPKPVIEYLNTCFEELQEEGLHKK

SEQ ID NO: 7453 - protein, 582 aa, Glycine max
  misc_feature (1)..(582): useful for making plants with modified plant phenotypes as described in USSN 12/139,269
  misc_feature (1)..(582): Public GI no. 56784222
  misc_feature (1)..(582): Utility: Useful for making plants sterile and for genetic confinement
MEAVAGGGGGGGGESVGELLLRAAAMVPAEHYALAALAVVSVLAYGFLELHFLGDLLRGFRGGRVELTFHPASEIYHRVASKCRSLHGRYLATPWLASPHLQTLFLGISGRPPSFTYKRQLYTVHDGGTIALDWLLATDSKGSDGILSEDASAPLVVIVPGLTSDSAAAYVKHMAYSMATKGCNTVVSNHRGLGGVSITSDCLYNAGWTEDLREVINYLHHKYPKAPMLCVGTSIGANIVVKYLGEEGENTPVAGAASICSPWDLVVGDRFISRKLVQRFYDKALAFGLKGYAKLHEPVLVRLANWEGIKKSRSIREFDHHATCMVAKYETVDTYYRRCSSASYVGNVSVPLLCVNALDDPLCTREAIPWDECRANKNIVLATTPNGGHLAFFQGLTAGRLWWVGAVSEFLFALLDSKYMHQQKAQDHILRSSLESSIDKSPYVNVMEDGMIAPVTDDGPCDDITPSHQVNDIKQDNGDFTQQNEHTREVDDKNITEVNAMPSQSPEQSAGQQVEEHYVGKFHEAIAPVKRSINQLTRYQGKSVWLLAYIAFVTSWPLLGSLAFIAFRKKFRNNLLAKWLRR

SEQ ID NO: 7454 - DNA, 1133 bp, Glycine max
  misc_feature (1)..(1133): useful for making plants with modified plant phenotypes as described in USSN 12/139,269
  misc_feature (1)..(1133): Ceres CLONE ID no. 566317
  misc_feature (1)..(1133): Also known as  Ceres CDNA ID no. 23693659
  misc_feature (622)..(622): s is g or c
  misc_feature (625)..(625): m is a or c
  misc_feature (660)..(660): k is g or t/u
  misc_feature (707)..(707): m is a or c
  misc_feature (709)..(709): y is t/u or c
  misc_feature (713)..(713): w is a or t/u
  misc_feature (724)..(724): w is a or t/u
  misc_feature (729)..(729): s is g or c
  misc_feature (738)..(738): s is g or c
  misc_feature (782)..(782): k is g or t/u
  misc_feature (842)..(842): k is g or t/u
  misc_feature (875)..(875): y is t/u or c
aaagaaacaattaaaataataaacctaaaagccctaacatatctatccccaacagtaaaagaaagcagattcatactctctccctctctctttagtctttaccaccacctggcctgcttttaaaacttgttcttcctctctcacatgaagacactagtcatggacacaacctcatcaacccctcaagactcatcatcctccaagaggcacttccactggacgaacaaggttggaaatgaagacccccaactcgccacctcagaaacgatgtcaaaaatcatagaagaagaagacacaaacacaaaggaaaaagaacaagaagaagatgacaaggctgttccacttccaggccctgccacaaagagaaagattcaggcagtggcaatctcaaggctccgatctgttctgactgtgttcagcaaaaaccaccgttccaacctccccttcggcctcggctccagagtcgttggcaccctcttcggctaccgccgcggccacgtgcatttcgccttccagagggaccccacttcgcaacccgccttcctcatcgagctcgcgaccccaatcagcggacttgtccgcgaaatggcgtctgggctggtgagaattgctttggagtgtsacmaggacaaagactcagaggagaagaagacgacgaakaagaacaagaccctgaggctgcttcaggagtccgtgtggaggacctmcygcawcggtaaaaagwgcggstttgccacsagaagagaatgtggagccaaagactgggacatactgaaggcagkggagccaatttctatgggtgcaggtgttttgcctaacagtgatgggtctgatggtgaagkcatgtacatgagggctaggtttgagagaattgytggttccagagactctgaagctttctacatgatgaatcctgacagcaatggagcacctgagctcagtatttacttgcttagagtctagtactgctgctgccactaccagcccccccccagtcatctgtttagttatttatactttaactttctttcccttttttagtttcttctttgtggatgatgttaaacactaggctattcctatactacttgtttagctccttaatcatgaacaatggtgacctagttttcttc

SEQ ID NO: 7455 - protein, 272 aa, Glycine max
  misc_feature (1)..(272): useful for making plants with modified plant phenotypes as described in USSN 12/139,269
  misc_feature (106)..(272): Pfam Name: DUF617; Pfam Description: Protein of unknown function, DUF617
  misc_feature (1)..(272): Utility: Useful for making plants sterile and for genetic confinement
  misc_feature (1)..(272): Utility: Useful for making smaller plants
  misc_feature (1)..(272): Utility: Useful for making stronger plants
MKTLVMDTTSSTPQDSSSSKRHFHWTNKVGNEDPQLATSETMSKIIEEEDTNTKEKEQEEDDKAVPLPGPATKRKIQAVAISRLRSVLTVFSKNHRSNLPFGLGSRVVGTLFGYRRGHVHFAFQRDPTSQPAFLIELATPISGLVREMASGLVRIALECDKDKDSEEKKTTKKNKTLRLLQESVWRTYCNGKKCGFATRRECGAKDWDILKAVEPISMGAGVLPNSDGSDGEVMYMRARFERIVGSRDSEAFYMMNPDSNGAPELSIYLLRV

SEQ ID NO: 7456 - protein, 277 aa, Glycine max
  misc_feature (1)..(277): useful for making plants with modified plant phenotypes as described in USSN 12/139,269
  misc_feature (1)..(277): Public GI no. 62320932
  misc_feature (1)..(277): Utility: Useful for making plants sterile and for genetic confinement
  misc_feature (1)..(277): Utility: Useful for making smaller plants
  misc_feature (1)..(277): Utility: Useful for making stronger plants
MAKDFASKRHNSFHWTRKVGSDENDDVSSHKPLPHHNNTKPSSSSSSSSSNVITHKKKLQSFAVSRLRSVIATLSRARPGNQNSGLGSRVVGTLFGSRRGHVHFSIQKDPNSPPAFLIELATPISGLVKEMASGLVRIALECDKGKEEEEGEEKNGTLRHGGGDKTKTTTTAAVSRRLVEEPMWRTYCNGKKCGFATRRECGEKEKKVLKALEMVSMGAGVLPETEEIGGGGGGGGDIMYMRAKFERIVGSRDSEAFYMMNPDSNGAPELSIYLLRI

SEQ ID NO: 7457 - protein, 247 aa, Brassica napus
  misc_feature (1)..(247): useful for making plants with modified plant phenotypes as described in USSN 12/139,269
  misc_feature (1)..(247): Ceres CLONE ID no. 961315
  misc_feature (1)..(247): Utility: Useful for making plants sterile and for genetic confinement
  misc_feature (1)..(247): Utility: Useful for making smaller plants
  misc_feature (1)..(247): Utility: Useful for making stronger plants
  misc_feature (146)..(146): Xaa is any aa, unknown or other
  misc_feature (147)..(147): Xaa is any aa, unknown or other
  misc_feature (154)..(154): Xaa is any aa, unknown or other
  misc_feature (156)..(156): Xaa is any aa, unknown or other
  misc_feature (161)..(161): Xaa is any aa, unknown or other
  misc_feature (173)..(173): Xaa is any aa, unknown or other
  misc_feature (183)..(183): Xaa is any aa, unknown or other
  misc_feature (186)..(186): Xaa is any aa, unknown or other
  misc_feature (192)..(192): Xaa is any aa, unknown or other
  misc_feature (205)..(205): Xaa is any aa, unknown or other
  misc_feature (207)..(207): Xaa is any aa, unknown or other
  misc_feature (219)..(219): Xaa is any aa, unknown or other
MVDLGKHHHHMQLITTPTTVDCARELRHRRTLRSLIECILPYCCTYQQPSPSCQNDTVSVSSSSSSSSSSDHSSSSSSSSSSSRSNSIISGTFFGHRRGRVSFCLQDTAVGSPPLLLLELAVPTAKLAKEMDQAGVLRIALECDRXXSSNSGPXSXFDVPXWSMYCNGRKMGXAVRRKVTENXAVXLRMMQXVSVGAGVVPVDKXEXTLYLRARFERVXGSSDSESFHMMNPGGSYGQELSIFLLRS

SEQ ID NO: 7458 - protein, 239 aa, Triticum aestivum
  misc_feature (1)..(239): useful for making plants with modified plant phenotypes as described in USSN 12/139,269
  misc_feature (1)..(239): Ceres CLONE ID no. 786659
  misc_feature (1)..(239): Utility: Useful for making plants sterile and for genetic confinement
  misc_feature (1)..(239): Utility: Useful for making smaller plants
  misc_feature (1)..(239): Utility: Useful for making stronger plants
MAFSSACPSFHSEDFVSPPKKPVTGTAAPAQEKQQQRRKVRTAVARLRSALSAAVSGRRRQVGLGARLTGTLYGHRRGHVHLAFQTDPRACPALLLELAAPTGALVREMASGLVRIALECERAKAATGGGDGGGRKLVEETVWRAYVNGKSCGYAVRRECGAADWRVLRALEPVSMGAGVIPAASCGGGEGDVMYMRARFERVVGSRDSEAFYMMNPDSSSSGSGINGGPELSVYLLRV

SEQ ID NO: 7459 - protein, 263 aa, Zea mays
  misc_feature (1)..(263): useful for making plants with modified plant phenotypes as described in USSN 12/139,269
  misc_feature (1)..(263): Ceres CLONE ID no. 276062
  misc_feature (1)..(263): Utility: Useful for making plants sterile and for genetic confinement
  misc_feature (1)..(263): Utility: Useful for making smaller plants
  misc_feature (1)..(263): Utility: Useful for making stronger plants
MKSSEAEDDDETTMAFSSACTSFHSDGFVSPPLKPAPSDHIQQVAAAAAGQRRRMKVRTAVSRLRSALANAVAGRHRQVGMGARLTGTLYGHRRGHVHLAFQVDPRACPALLLELAAPTAALVREMASGLVRIALECDRARARGSPAAALPSPSPGAGKRLVEETVWRAYCNGKSCGYAVRRECGAADWRVLRALEPVSMGAGVIPAASCGGGEGDVMYMRARFERVVGSRDSEAFYMMNPDGSGGGAHGHGGPELSVYLLRV

SEQ ID NO: 7460 - protein, 223 aa, Zea mays
  misc_feature (1)..(223): useful for making plants with modified plant phenotypes as described in USSN 12/139,269
  misc_feature (1)..(223): Ceres CLONE ID no. 284925
  misc_feature (1)..(223): Utility: Useful for making plants sterile and for genetic confinement
  misc_feature (1)..(223): Utility: Useful for making smaller plants
  misc_feature (1)..(223): Utility: Useful for making stronger plants
  misc_feature (165)..(165): Xaa is any aa, unknown or other
MQAGACPDRGAVVAARRRRRRAVVGLIELAADAAHRVVLLRRGRVVAPPPHRHALRLPRRPRVAVAAAERAVPAHAGGRAGAPDARAAPRARRPRGRAHRAGGREARRAGHRRRQRGHRHHRPRRVGAGGAHVDHVLQRQEGGYAVRRDPTEEDIAVLETLWAVXMGGGVLPGRSDMDGPDGEMAYMRGSFEHTVGSRDSESLYMVGPPGGDCPELAIFFVRL

SEQ ID NO: 7461 - DNA, 889 bp, Arabidopsis thaliana
  misc_feature (1)..(889): useful for making plants with modified plant phenotypes as described in USSN 12/139,269
  misc_feature (1)..(889): Ceres CLONE ID no. 28003
  misc_feature (1)..(889): Also known as  Ceres CDNA ID no. 23387939
cttttcaacacactactgatcttgagaatcctctcttcaaagccatggcgttagaactatggcaaactctcaaagaagcaatccatgcttacacaggtctttctcctgttgtcttcttcactgctctagctctcgccttcgccatttaccaagtcatctcaggctggtttgcctcgccgttcgatgatgttaaccgacatcagagagctagatccttggctcaagaggaggagccaccgattcctcagcctgttcaagtcggtgagatcacggaggaggagcttaaacagtacgatggctctgatcctcaaaagccccttcttatggctatcaaacatcagatctatgatgttacacaaagcaggatgttctacggaccaggaggaccatatgctttgtttgcagggaaagacgctagccgagctcttgcaaagatgtcatttgaggagaaagacttgacttgggatatctctggtcttggtccctttgagctagatgctcttcaagattgggagtacaagttcatgagcaagtatgctaaggttggtactgtcaaagtggctggttcagaacctgaaaccgcatctgtctctgaacccacagagaatgttgagcaagatgctcatgtaaccacaacgcctgagaagaccgttgttgataagagtgatgatgctcctgctgagactgtgttgaagaaggaggagtagagcccatttccaagatttgctctgatttgtcatagagaccagttttatgaaaaggattgtagaatctctaatgttgaagtgtcaatgataatcttgttttactttcccaaaaaataaagattgctgattaatgataagaaaaaaatgttttataaactgcatatcagaaggcgttgcattgc

SEQ ID NO: 7462 - protein, 220 aa, Arabidopsis thaliana
  misc_feature (1)..(220): useful for making plants with modified plant phenotypes as described in USSN 12/139,269
  misc_feature (74)..(171): Pfam Name: Cyt-b5; Pfam Description: Cytochrome b5-like Heme/Steroid binding domain
  misc_feature (74)..(171): Pfam Name: Cyt-b5; Pfam Description: Cytochrome b5-like Heme/Steroid binding domain
  misc_feature (1)..(220): Utility: Useful for making plants sterile and for genetic confinement
  misc_feature (1)..(220): Utility: Useful for making smaller plants
MALELWQTLKEAIHAYTGLSPVVFFTALALAFAIYQVISGWFASPFDDVNRHQRARSLAQEEEPPIPQPVQVGEITEEELKQYDGSDPQKPLLMAIKHQIYDVTQSRMFYGPGGPYALFAGKDASRALAKMSFEEKDLTWDISGLGPFELDALQDWEYKFMSKYAKVGTVKVAGSEPETASVSEPTENVEQDAHVTTTPEKTVVDKSDDAPAETVLKKEE

SEQ ID NO: 7463 - protein, 218 aa, Brassica napus
  misc_feature (1)..(218): useful for making plants with modified plant phenotypes as described in USSN 12/139,269
  misc_feature (1)..(218): Ceres CLONE ID no. 980499
  misc_feature (1)..(218): Utility: Useful for making plants sterile and for genetic confinement
  misc_feature (1)..(218): Utility: Useful for making smaller plants
MALLLWQTLKEAIHAYTGLSPVVFFTALALAFSIYQVVSGWFASPFDDVRRHQRARSSAAEEAPPIPQPVQVGEITEEELKQYDGSDPQKPLLMAIKHQIYDVTQSRMFYGPGGPYALFAGKDASRALAKMSFEEKDLTWDISGLGPFELEALQDWEYKFKSKYATVGTVKVTVSEAETASVSEPAETDDGDAHVIKQEPTVVDKNLETPAESDVKNE

SEQ ID NO: 7464 - protein, 219 aa, Zea mays
  misc_feature (1)..(219): useful for making plants with modified plant phenotypes as described in USSN 12/139,269
  misc_feature (1)..(219): Ceres CLONE ID no. 1381318
  misc_feature (1)..(219): Utility: Useful for making plants sterile and for genetic confinement
  misc_feature (1)..(219): Utility: Useful for making smaller plants
  misc_feature (78)..(78): Xaa is any aa, unknown or other
  misc_feature (81)..(81): Xaa is any aa, unknown or other
  misc_feature (85)..(85): Xaa is any aa, unknown or other
  misc_feature (93)..(93): Xaa is any aa, unknown or other
MALLLWQTLKEAIHAYTGLSPVVFFTALALAFSIYQVVSGWFASPFDDVRRHQRARSSAAEEAPPIPQPVQVGEITEXELXQYDXLPILKSPXSMAIKHQIYDVTQSRMFYGPGGPYALFAGKDASRALAKMSFEEKDLTWDISGLGPFELEALQDWEYKFKSKYATVGTVKVTVSEAETASVSEPAETDDGDAHVIKQEPTVVDKNLETPAESDVKNE

SEQ ID NO: 7465 - DNA, 639 bp, Zea mays
  misc_feature (1)..(639): useful for making plants with modified plant phenotypes as described in USSN 12/139,269
  misc_feature (1)..(639): Ceres CLONE ID no. 225200
  misc_feature (1)..(639): Also known as  Ceres CDNA ID no. 23746143
aagacaaagccagcaccacacaagcaggcaggaagggaagccctcgctctcgctcacccctgtctggcgtctgcttatccctggagcagaccggagtaaggccagccaaccaaattgtctatctactgaaggaaggagaaaaaaaaagagattcaacaagttgttgcagctgcagctttaccgattcccatgggttccaagccgggtgaggcgccaacctgggcggaccagtgggcctctggcgagggcgacgggagcatcgcgaacggcaaggcggccggtaagaggacggtggccggcaacgtgaaggcggcggcgtcggagggactcgtcaaggccaaggcggcggcgctggtcggagcgcacaagctcaagaccgggacgagctcgggcatcaagtgggtcagggagcagtaccagaagaagaggacgtcgtccaagtgagctgcaatgtgtcaattgtgatggaggagcactgctactctctgttctgatctttcttagtgaagcccattagaggaacaggtttttctcttgggtggagactcttcttggacgctttggttcctttggatggtgagcttgtaagccgctggccttttttttcattattatgccagactagtatgatttttgcgt

SEQ ID NO: 7466 - protein, 84 aa, Zea mays
  misc_feature (1)..(84): useful for making plants with modified plant phenotypes as described in USSN 12/139,269
  misc_feature (1)..(84): Utility: Useful for making plants that grow better in shade
  misc_feature (1)..(84): Utility: Useful for making plants with altered leaf shape eg curled leaves
  misc_feature (1)..(84): Utility: Useful for making plants with increased biomass and foliage
  misc_feature (1)..(84): Utility: Useful for making smaller plants
MGSKPGEAPTWADQWASGEGDGSIANGKAAGKRTVAGNVKAAASEGLVKAKAAALVGAHKLKTGTSSGIKWVREQYQKKRTSSK

SEQ ID NO: 7467 - protein, 88 aa, Zea mays
  misc_feature (1)..(88): useful for making plants with modified plant phenotypes as described in USSN 12/139,269
  misc_feature (1)..(88): Public GI no. 38093751
  misc_feature (1)..(88): Utility: Useful for making plants that grow better in shade
  misc_feature (1)..(88): Utility: Useful for making plants with altered leaf shape eg curled leaves
  misc_feature (1)..(88): Utility: Useful for making plants with increased biomass and foliage
  misc_feature (1)..(88): Utility: Useful for making smaller plants
MGSKKDAQTWADQWGSSGGDGSFKKGGGGGGSSGNSEKKTVAGNVKAAASEGLVKAKAAALVGAHKVKSGTSSGIKWVKGQYQKRAGK

SEQ ID NO: 7468 - protein, 85 aa, Glycine max
  misc_feature (1)..(85): useful for making plants with modified plant phenotypes as described in USSN 12/139,269
  misc_feature (1)..(85): Ceres CLONE ID no. 646162
  misc_feature (1)..(85): Utility: Useful for making plants that grow better in shade
  misc_feature (1)..(85): Utility: Useful for making plants with altered leaf shape eg curled leaves
  misc_feature (1)..(85): Utility: Useful for making plants with increased biomass and foliage
  misc_feature (1)..(85): Utility: Useful for making smaller plants
MGSKGPSWSDQWGSGGFGSDHYEEEEKMKMKKSGSSKKMADAKAVASAGMDKAKTAAVVGAQKVKSGTSAGLKWVKNQYQKRTSK

SEQ ID NO: 7469 - DNA, 1218 bp, Arabidopsis thaliana
  misc_feature (1)..(1218): useful for making plants with modified plant phenotypes as described in USSN 12/139,269
  misc_feature (1)..(1218): Ceres CLONE ID no. 19080
  misc_feature (1)..(1218): Also known as  Ceres CDNA ID no. 23376262
atgctcaccacttcacctctctctctctttcttctccactgtaacctcccaattcaaaaacaattataaaccaaacttgattaatatatatttctttatcatcatctcttcgaaatgcaagatattcatgatttctccatgaacggagttggtggtgggggaggaggaggagggaggtttttcggtggaggaatcggcggcggaggaggtggtgatcgaaggatgagagctcatcagaacaatatacttaaccatcatcaatctctcaagtgtcctcgttgtaattctcttaacacaaagttctgttactacaacaattacaatctttctcagcctcgtcacttttgcaagaactgtcgtcgttactggactaaaggtggtgttctccgtaacgttcccgtcggaggtggttgccggaaagctaaacgttcgaaaacaaaacaggttccgtcgtcgtcatcagccgacaaaccaacgacgacgcaagatgatcatcacgtggaggagaaatcgagtacaggatctcactctagcagcgagagctcttctctcaccgcttctaactctaccaccgtcgccgccgtctccgtcaccgcggcggcggaagttgcttcgtcggttattccaggttttgatatgcctaatatgaaaatttacggtaacgggatcgagtggtcgacgttacttggacaaggctcatcggccggtggtgttttctcggagatcggtggttttccggcggtttcagctattgaaactacaccgtttggattcgggggtaaattcgtaaatcaagatgatcatctgaagttagaaggtgaaactgtacagcagcaacagtttggagatcgaacggctcaggttgagtttcaaggaagatcttcggatccgaatatgggatttgaaccgttggattggggaagtggcggtggagatcaaacactgtttgatttaaccagtaccgttgatcatgcatactggagtcaaagtcaatggacgtcgtctgaccaagatcagagtggtctctaccttccttgattctgatcatagcttcttcttcttaacccaaaaatatatattttatacacataaggtaaagttcgatgaagtggtttttttaatttttatttgatgggtctaaaacgggatttattatataattatatgactgcttgtaaatttttttcccaaatatcaaatttacctctcttttttttt

SEQ ID NO: 7470 - protein, 307 aa, Arabidopsis thaliana
  misc_feature (1)..(307): useful for making plants with modified plant phenotypes as described in USSN 12/139,269
  misc_feature (46)..(108): Pfam Name: zf-Dof; Pfam Description: Dof domain, zinc finger
  misc_feature (1)..(307): Utility: Useful for making plants with altered leaf shape eg curled leaves
  misc_feature (1)..(307): Utility: Useful for making plants with increased biomass and foliage
MQDIHDFSMNGVGGGGGGGGRFFGGGIGGGGGGDRRMRAHQNNILNHHQSLKCPRCNSLNTKFCYYNNYNLSQPRHFCKNCRRYWTKGGVLRNVPVGGGCRKAKRSKTKQVPSSSSADKPTTTQDDHHVEEKSSTGSHSSSESSSLTASNSTTVAAVSVTAAAEVASSVIPGFDMPNMKIYGNGIEWSTLLGQGSSAGGVFSEIGGFPAVSAIETTPFGFGGKFVNQDDHLKLEGETVQQQQFGDRTAQVEFQGRSSDPNMGFEPLDWGSGGGDQTLFDLTSTVDHAYWSQSQWTSSDQDQSGLYLP

SEQ ID NO: 7471 - DNA, 972 bp, Arabidopsis thaliana
  misc_feature (1)..(972): useful for making plants with modified plant phenotypes as described in USSN 12/139,269
  misc_feature (1)..(972): Ceres CLONE ID no. 125409
  misc_feature (1)..(972): Also known as  Ceres CDNA ID no. 23649551
acaccgatccaatgtcggaagaagaacaaaaccctgatccgatgtcggaagaaagagaacaaaacccgaatccgatgatctacctatgtcccgatctagtggaagaaatcgtccttggattgccgttgaaattcaatcctcagattcaaaacggtctcaaaacaatggagatcaatccttggattgtgagatttttgatgtcaatattggtgaatggcggagatcgaggagcccccctccttattgggtggatcccagaaggaagtctgcgtgtgttcagggctccatctactggttaaatgtcaaacctttccaggtactagctttggatcttcacacacaagagttccataatgttcgctcaagacctactcacgcaacttatgccgaccaacttgtcaaccttgatgaccgtctagccatagcctaatcgtttttgcatcctccttggatactatggatatggaccatggatgttctaaaagatgatggatggaccaaggcttactccatagatttatcctcctgtagagatcttaccgtggaaagtgcatttcaggccggtggcggtttctaagcatgggaatgtttacttgcatgacaatgaaaagaggttgttgaaatactatccaaagaccaacctccttcgttgcatctctaaagacacttgggtcatatcccctatggttgagaatgtgcttccacttcggcctctaggctctattcccaagacattcggctacggatccatatctcaggagcttaaccacatgccgggatcgaggatgtccaaatttcttagcagaatcccaactatactgtttacaaccactctagtgtctcaagttgtttaccgctatttgtcttgatgttgactttatactcgctgaatgttgttatgtctgtcagtatattaagtatgaacttgtttgatctttgaaacatttatcttcactcttgcttgtgacttct

SEQ ID NO: 7472 - protein, 114 aa, Arabidopsis thaliana
  misc_feature (1)..(114): useful for making plants with modified plant phenotypes as described in USSN 12/139,269
  misc_feature (1)..(114): Utility: Useful for making plants with altered leaf shape eg curled leaves
  misc_feature (1)..(114): Utility: Useful for making smaller plants
MSRSSGRNRPWIAVEIQSSDSKRSQNNGDQSLDCEIFDVNIGEWRRSRSPPPYWVDPRRKSACVQGSIYWLNVKPFQVLALDLHTQEFHNVRSRPTHATYADQLVNLDDRLAIA

SEQ ID NO: 7473 - DNA, 705 bp, Zea mays
  misc_feature (1)..(705): useful for making plants with modified plant phenotypes as described in USSN 12/139,269
  misc_feature (1)..(705): Ceres CLONE ID no. 301326
  misc_feature (1)..(705): Also known as  Ceres CDNA ID no. 23744280
aataaaccaagatagtgagatgtgtctccatcataccacaccatgtgatgcgaggagcctcttctgcctctcatccccctacttccaagatgcaatcatgctgccccagactcctcgggccctcggccaccatgattgcctcaccgcctctcaggagtcgcctccacctacttccaagaggaagaggccggagaagctatagtccatgaggaaattaagcggaggggcggcggccggtgaacgaggggccggaggaggaggagagagaaggggaggtggcagaaaaagctagagagagagagagacagagatgcatggtgcatggcatgatgatggcgtggttgatctattcgatccagtacttctgtgatcattcgagtcaagaagccatcatcagatcggtgcagttctccctcctccttccagctcctcctcagcttctttgtaacactgcgcccgccatggctttggggaatcaagcgtcttggtccgaaatccttctttcctagctaggaactacgtacttgtacgtgcaagagtatgtatgttatccctgcatgttcttattctgtctctatatatggtttatgcagacagagcaagattcgttcgtcttgattgatttgtttccatcactctttgattcagagtttgattcatgtaatattttgttagttatgtggatttcttctttgagctttttct

SEQ ID NO: 7474 - protein, 60 aa, Zea mays
  misc_feature (1)..(60): useful for making plants with modified plant phenotypes as described in USSN 12/139,269
  misc_feature (1)..(60): Utility: Useful for making plants with altered leaf shape eg curled leaves
MCLHHTTPCDARSLFCLSSPYFQDAIMLPQTPRALGHHDCLTASQESPPPTSKRKRPEKL

SEQ ID NO: 7475 - protein, 58 aa, Triticum aestivum
  misc_feature (1)..(58): useful for making plants with modified plant phenotypes as described in USSN 12/139,269
  misc_feature (1)..(58): Ceres CLONE ID no. 908026
  misc_feature (1)..(58): Utility: Useful for making plants with altered leaf shape eg curled leaves
LHHSTPCDARSASLSSSSPNFQEAIMLPGAPWALRHHHHHLLLFPPAPTSKKERSGEL

SEQ ID NO: 7476 - DNA, 686 bp, Glycine max
  misc_feature (1)..(686): useful for making plants with modified plant phenotypes as described in USSN 12/139,269
  misc_feature (1)..(686): Ceres CLONE ID no. 681088
  misc_feature (1)..(686): Also known as  Ceres CDNA ID no. 23400925
tgccactctatacactgtgaatggaccatcaacctccaccgtgccccgccgccgcctccgcaacggacaaccctcgtggcggaacgcgccaccccatgtaccgcggcgtccgcaagcgccggtggggcaaatgggtctccgaaatccgggagccacggaagaagaaccgcatatggttggggtcgtttccggtgccggagatggcggcacgagcatacgacgtcgcagcctactgcctcaaaggccggaaggcgcagctcaactttcccgacgacgtcgactccctgccgcttccgtcgtcccgcacggcaagagacattcagaccgccgcggcccaggcggcgcgtatgatgaaagcttccggcaatgatgagaaaagcggcattgcctccgacgacggcgatagcggttgcgatgatttttggggcgagattgagttgccagagctgatggacggcgagtgctactggggttgtccggccggcgcttcctcctggacttcctccggcgatctcgccgagtggccggaggaggagctttcgccgcagcaaccgtcgtttatggcatgtctataatctactgtatctctgtattaatgctgcatgttcagttgttgttggtatgtttcttgtattatatatcctattcctaatgttatatcctatgtgccaactgttcctgttgtc

SEQ ID NO: 7477 - protein, 184 aa, Glycine max
  misc_feature (1)..(184): useful for making plants with modified plant phenotypes as described in USSN 12/139,269
  misc_feature (25)..(88): Pfam Name: AP2; Pfam Description: AP2 domain
  misc_feature (1)..(184): Utility: Useful for making plants with altered leaf shape eg curled leaves
  misc_feature (1)..(184): Utility: Useful for making plants with increased biomass and foliage
  misc_feature (1)..(184): Utility: Useful for making smaller plants
MDHQPPPCPAAASATDNPRGGTRHPMYRGVRKRRWGKWVSEIREPRKKNRIWLGSFPVPEMAARAYDVAAYCLKGRKAQLNFPDDVDSLPLPSSRTARDIQTAAAQAARMMKASGNDEKSGIASDDGDSGCDDFWGEIELPELMDGECYWGCPAGASSWTSSGDLAEWPEEELSPQQPSFMACL

SEQ ID NO: 7478 - protein, 192 aa, Glycine max
  misc_feature (1)..(192): useful for making plants with modified plant phenotypes as described in USSN 12/139,269
  misc_feature (1)..(192): Public GI no. 18378818
  misc_feature (1)..(192): Utility: Useful for making plants with altered leaf shape eg curled leaves
  misc_feature (1)..(192): Utility: Useful for making plants with increased biomass and foliage
  misc_feature (1)..(192): Utility: Useful for making smaller plants
MSPQRMKLSSPPVTNNEPTATASAVKSCGGGGKETSSSTTRHPVYHGVRKRRWGKWVSEIREPRKKSRIWLGSFPVPEMAAKAYDVAAFCLKGRKAQLNFPEEIEDLPRPSTCTPRDIQVAAAKAANAVKIIKMGDDDVAGIDDGDDFWEGIELPELMMSGGGWSPEPFVAGDDATWLVDGDLYQYQFMACL

SEQ ID NO: 7479 - protein, 187 aa, Glycine max
  misc_feature (1)..(187): useful for making plants with modified plant phenotypes as described in USSN 12/139,269
  misc_feature (1)..(187): Public GI no. 25406719
  misc_feature (1)..(187): Utility: Useful for making plants with altered leaf shape eg curled leaves
  misc_feature (1)..(187): Utility: Useful for making plants with increased biomass and foliage
  misc_feature (1)..(187): Utility: Useful for making smaller plants
MKLSSPPVTNNEPTATASAVKSCGGGGKETSSSTTRHPVYHGVRKRRWGKWVSEIREPRKKSRIWLGSFPVPEMAAKAYDVAAFCLKGRKAQLNFPEEIEDLPRPSTCTPRDIQVAAAKAANAVKIIKMGDDDVAGIDDGDDFWEGIELPELMMSGGGWSPEPFVAGDDATWLVDGDLYQYQFMACL

SEQ ID NO: 7480 - protein, 192 aa, Arabidopsis thaliana
  misc_feature (1)..(192): useful for making plants with modified plant phenotypes as described in USSN 12/139,269
  misc_feature (1)..(192): Ceres CLONE ID no. 25524
  misc_feature (1)..(192): Utility: Useful for making plants with altered leaf shape eg curled leaves
  misc_feature (1)..(192): Utility: Useful for making plants with increased biomass and foliage
  misc_feature (1)..(192): Utility: Useful for making smaller plants
MSPQRMKLSPPPVTNNEPTATASAVKSCGGGGKETSSSTTRHPVYHGVRKRRWGKWVSEIREPRKKSRIWLGSFPVPEMAAKAYDVAAFCLKGRKAQLNFPEEIEDLPRPSTCTPRDIQVAAAKAANAVKIIKMGDDDVAGIDDGDDFWEGIELPELMMTGGGWSPEPFVAGDDATWLVDGDLYQYQFMACL

SEQ ID NO: 7481 - protein, 187 aa, Arabidopsis thaliana
  misc_feature (1)..(187): useful for making plants with modified plant phenotypes as described in USSN 12/139,269
  misc_feature (1)..(187): Public GI no. 21554403
  misc_feature (1)..(187): Utility: Useful for making plants with altered leaf shape eg curled leaves
  misc_feature (1)..(187): Utility: Useful for making plants with increased biomass and foliage
  misc_feature (1)..(187): Utility: Useful for making smaller plants
MKLSPPPVTNNEPTATASAVKSCGGGGKETSSSTTRHPVYHGVRKRRWGKWVSEIREPRKKSRIWLGSFPVPEMAAKAYDVAAFCLKGRKAQLNFPEEIEDLPRPSTCTPRDIQVAAAKAANAVKIIKMGDDDVAGIDDGDDFWEGIELPELMMTGGGWSPEPFVAGDDATWLVDGDLYQYQFMACL

SEQ ID NO: 7482 - protein, 185 aa, Brassica napus; identical to SEQ ID NO: 6147
  misc_feature (1)..(185): useful for making plants with modified plant phenotypes as described in USSN 12/139,269
  misc_feature (1)..(185): Ceres CLONE ID no. 973892
  misc_feature (1)..(185): Utility: Useful for making plants with altered leaf shape eg curled leaves
  misc_feature (1)..(185): Utility: Useful for making plants with increased biomass and foliage
  misc_feature (1)..(185): Utility: Useful for making smaller plants

SEQ ID NO: 7483 - DNA, 974 bp, Glycine max
  misc_feature (1)..(974): useful for making plants with modified plant phenotypes as described in USSN 12/139,269
  misc_feature (1)..(974): Ceres CLONE ID no. 681222
  misc_feature (1)..(974): Also known as  Ceres CDNA ID no. 25087671
agatttctcattcgtcatggaacagattcactctctctctctttagagatttgattgacaaacacaactaattccaaagctaacaactttatagagagagagagagagagagagagagatggagggtgaaggaagaagaagagaaggaggagagagagaaacagcaacagcagcagcaacgaggaaggtggtggagggtgctgatcagagaagatacaaaggaataaggatgaggaagtggggcaagtgggtcgctgaaattagagaacccaataagcgttcaaggatttggctcggttcctattctacccctgtcgcagccgcacgtgcctacgacaccgccgtcttttaccttcgaggaccctccgcgcgtcttaacttcccggagcttctcatcggagaaggcgccgccgccctcaccggcggctgtgacatgtcagcagcttctattaggaagaaggcctccgaggtcggtgctagagtcgatgctcttcaggcaacccttcaccaccatcaccaccatgttgtgccaccacggcagcttctctctgccagctgtggcggtgggtccggtgattttgcagtgcgggttgttgacctgaataagatgcccgaacccgagagctccgactgtgagtggaacgtgaattgaaggaaaaagaaaaaaggtgcatgttttcatattcaggtgatggtggttgttaacgtgcgccggctgaggcaaaatgatgttgttgatgaggcctgtggtggtggtggtggtggtgcggagtactgtactgtatcttttttccttcaaccttctctcttgggtagtttttttttaaaatttttagatattacaaaagaatttttggcttgtaaaaatatgttaaatgtaaattaactagtccggtagcagtttctttttaaaaaaaaaaaaaaaaaaaaaaaaaaaaaaaaaaaaaaaaaaaaaaaaaaaaaaaaaaaaaaaa

SEQ ID NO: 7484 - protein, 177 aa, Glycine max
  misc_feature (1)..(177): useful for making plants with modified plant phenotypes as described in USSN 12/139,269
  misc_feature (31)..(94): Pfam Name: AP2; Pfam Description: AP2 domain
  misc_feature (1)..(177): Utility: Useful for making plants with altered leaf shape eg curled leaves
  misc_feature (1)..(177): Utility: Useful for making plants with increased biomass and foliage
MEGEGRRREGGERETATAAATRKVVEGADQRRYKGIRMRKWGKWVAEIREPNKRSRIWLGSYSTPVAAARAYDTAVFYLRGPSARLNFPELLIGEGAAALTGGCDMSAASIRKKASEVGARVDALQATLHHHHHHVVPPRQLLSASCGGGSGDFAVRVVDLNKMPEPESSDCEWNVN

SEQ ID NO: 7485 - protein, 168 aa, Glycine max
  misc_feature (1)..(168): useful for making plants with modified plant phenotypes as described in USSN 12/139,269
  misc_feature (1)..(168): Ceres CLONE ID no. 594823
  misc_feature (1)..(168): Utility: Useful for making plants with altered leaf shape eg curled leaves
  misc_feature (1)..(168): Utility: Useful for making plants with increased biomass and foliage
MESEGRREGGERETTAATRKVEGAERRYKGIRMRKWGKWVAEIREPNKRSRIWLGSYSTPVAAARAYDTAVFYLRGPSARLNFPELLVREGPAALVAGCDMSAASIRKKATEVGARVDALQATLHHHYVPPRQLLSGGGGGSGDFPVRVVDLNKMPEPESSDCEWDVN

SEQ ID NO: 7486 - protein, 196 aa, Glycine max
  misc_feature (1)..(196): useful for making plants with modified plant phenotypes as described in USSN 12/139,269
  misc_feature (1)..(196): Public GI no. 56381907
  misc_feature (1)..(196): Utility: Useful for making plants with altered leaf shape eg curled leaves
  misc_feature (1)..(196): Utility: Useful for making plants with increased biomass and foliage
METATEVATVVSTPAVTVAAVATRKRDKPYKGIRMRKWGKWVAEIREPNKRSRIWLGSYSTPEAAARAYDTAVFYLRGPSARLNFPELLAGVTVTGGGGGGVNGGGDMSAAYIRRKAAEVGAQVDALEAAGAGGNRHHHHHQHQRGNHDYVDNHSDYRINDDLMECSSKEGFKRCNGSLERVDLNKLPDPETSDDD

SEQ ID NO: 7487 - protein, 196 aa, Glycine max
  misc_feature (1)..(196): useful for making plants with modified plant phenotypes as described in USSN 12/139,269
  misc_feature (1)..(196): Public GI no. 16323159
  misc_feature (1)..(196): Utility: Useful for making plants with altered leaf shape eg curled leaves
  misc_feature (1)..(196): Utility: Useful for making plants with increased biomass and foliage
METATEVATVVSTPAVTVAAVATRKRDKPYKGIRMRKWGKWVAEIREPNKRSRIWLGSYSTPEAAARAYDTAVFYLRSPSARLNFPELLAGVTVTGGGGGGVNGGGDMSAAYIRRKAAEVGAQVDALEAAGAGGNRHHHHHQHQRGNHDYVDNHSDYRINDDLMECSSKEGFKRCNGSLERVDLNKLPDPETSDDD

SEQ ID NO: 7488 - protein, 249 aa, Zea mays
  misc_feature (1)..(249): useful for making plants with modified plant phenotypes as described in USSN 12/139,269
  misc_feature (1)..(249): Ceres CLONE ID no. 298090
  misc_feature (1)..(249): Utility: Useful for making plants with altered leaf shape eg curled leaves
  misc_feature (1)..(249): Utility: Useful for making plants with increased biomass and foliage
MQGEYRSSSEESAAAAAAAAMAPLAAAAAAAVKMEAEQAAMASAAAPQLGSAHQHQHQQMQPRRQYRGVRMRKWGKWVAEIREPHKRTRIWLGSYATAVAAARAYDTAVFYLRGRSARLNFPDEIPSLAPSEGEGEGDGGEPARDPADGGGTLSAASIRKKAIEVGSRVDALQTGMMVPPPHHRERQRHHHHHHHHLPQLRMHAAAAEAAAVAEHRQEVKQSPQRPAWSGRVKNPDLNRAPSPESSDAE

SEQ ID NO: 7489 - protein, 243 aa, Triticum aestivum
  misc_feature (1)..(243): useful for making plants with modified plant phenotypes as described in USSN 12/139,269
  misc_feature (1)..(243): Ceres CLONE ID no. 883658
  misc_feature (1)..(243): Utility: Useful for making plants with altered leaf shape eg curled leaves
  misc_feature (1)..(243): Utility: Useful for making plants with increased biomass and foliage
MQQGEYRSSSSSEGSAGSAAAAAAAAAMAPLAAAAAAVAAKEEHNVTVAVAPPMPMAMAMPLQQQQPRKQYRGVRMRKWGKWVAEIREPHKRTRIWLGSYATPVAAARAYDTAVFYLRGRSARLNFPDEISALALSSPEAAEAGGGEEPGDGGGALSAASIRKKAIEVGSRVDALQTGMTTMVAAPAHHRERQRLHHHHHHAEPHGEELHRHVKQQRTAWNGRAKNPDLNQAPSPDTSDAEAE

SEQ ID NO: 7490 - protein, 161 aa, Parthenium argentatum
  misc_feature (1)..(161): useful for making plants with modified plant phenotypes as described in USSN 12/139,269
  misc_feature (1)..(161): Ceres CLONE ID no. 1605060
  misc_feature (1)..(161): Utility: Useful for making plants with altered leaf shape eg curled leaves
  misc_feature (1)..(161): Utility: Useful for making plants with increased biomass and foliage
NSSTTTIIIIIMGAQHHHNTDCSSSRKNQIHNNKPYRGIRMRKWGKWVAEIREPNKRSRIWLGSYSSPVAAARAYDTAVFYLRGPSARLNFPDLVLDDRADLCDLSAAYIRKKATEVGAKVDALQNQTGGTRHHSPESYSGRVCLNTDLNEYPIPESSDGN

SEQ ID NO: 7491 - protein, 233 aa, Parthenium argentatum
  misc_feature (1)..(233): useful for making plants with modified plant phenotypes as described in USSN 12/139,269
  misc_feature (1)..(233): Public GI no. 50929183
  misc_feature (1)..(233): Utility: Useful for making plants with altered leaf shape eg curled leaves
  misc_feature (1)..(233): Utility: Useful for making plants with increased biomass and foliage
MQGEYHRSSSEDSAASAAAAAAAAAAAMAPLAAAAAAVAAKEEQAAAAAVLPLQQQQPRRQYRGVRMRKWGKWVAEIREPHKRTRIWLGSYATPVAAARAYDTAVFYLRGRSARLNFPEEISSLASLSEGGGASEPREPDGGTLSAASIRKKAIEVGSRVDALQTGMMVAPTTHHRERQKHHHHHHHHHPHLQPHGEEQHHHHEQKHQRTAWSGRAKNPDLNQAPSPENSDAE

SEQ ID NO: 7492 - DNA, 798 bp, Arabidopsis thaliana
  misc_feature (1)..(798): useful for making plants with modified plant phenotypes as described in USSN 12/139,269
  misc_feature (1)..(798): Ceres CLONE ID no. 11975
  misc_feature (1)..(798): Also known as  Ceres CDNA ID no. 23371180
aaatgggagagaaacaggaagtgaaactattaggagtatggtacagtccatacgccataagaactaagatcgctcttcgtctcaaatcagtcgattatgattatgttgaagaagatctgtttggatccaagagtgagcttcttctcaaatcaaacccggttcacaagaaagtccctgttctcctccactacaacaaaccgattgtcgagtctcttaacatcgttgaatacattgatgagacgtggaactcatctgcgccgtccattcttccttcacatccttatgatcgtgctcttgctcgcttttggtctgacttcgttgataacaagtggtttccggcgttgagagtggcggcgatcgctaaatcggaagacgcaaaagcgaaagccatggaagaagtggaagaagggttgttgcaactcgaggatgcgtttgtttctataagtaaagggaaacccttttttggcggtgaagtaatcgggtttatggatatttgctttggaagctttgtggttctcttgaaagctagagaaaagtttaaagcagaaaagcttttagacgaatcaaaaactccttctctttgtaaatgggccgaccggttcttgtccgatgaaacggtgaagaatgtggcaccggatatcgaaaaagtagctgagtttctacaagaacttgaggttagagctcaatccgcagcttcaagatcttgagatcatcttagaaatgtattgcaatgcaattgtgttttgtgtacatgtaaaacgaaaataagttgaagttttaaagtgttgtgttcagttc

SEQ ID NO: 7493 - protein, 234 aa, Arabidopsis thaliana
  misc_feature (1)..(234): useful for making plants with modified plant phenotypes as described in USSN 12/139,269
  misc_feature (7)..(79): Pfam Name: GST_N; Pfam Description: Glutathione S-transferase, N-terminal domain
  misc_feature (89)..(204): Pfam Name: GST_C; Pfam Description: Glutathione S-transferase, C-terminal domain
  misc_feature (1)..(234): Utility: Useful for making plants with altered leaf shape eg curled leaves
  misc_feature (1)..(234): Utility: Useful for making smaller plants
MGEKQEVKLLGVWYSPYAIRTKIALRLKSVDYDYVEEDLFGSKSELLLKSNPVHKKVPVLLHYNKPIVESLNIVEYIDETWNSSAPSILPSHPYDRALARFWSDFVDNKWFPALRVAAIAKSEDAKAKAMEEVEEGLLQLEDAFVSISKGKPFFGGEVIGFMDICFGSFVVLLKAREKFKAEKLLDESKTPSLCKWADRFLSDETVKNVAPDIEKVAEFLQELEVRAQSAASRS

SEQ ID NO: 7494 - protein, 227 aa, Arabidopsis thaliana
  misc_feature (1)..(227): useful for making plants with modified plant phenotypes as described in USSN 12/139,269
  misc_feature (1)..(227): Public GI no. 11096016
  misc_feature (1)..(227): Utility: Useful for making plants with altered leaf shape eg curled leaves
  misc_feature (1)..(227): Utility: Useful for making smaller plants
MASSDVKLIGAWASPFVMRPRIALNLKSVPYEFLQETFGSKSELLLKSNPVHKKIPVLLHADKPVSESNIIVEYIDDTWSSSGPSILPSDPYDRAMARFWAAYIDEKWFVALRGFLKAGGEEEKKAVIAQLEEGNAFLEKAFIDCSKGKPFFNGDNIGYLDIALGCFLAWLRVTELAVSYKILDEAKTPSLSKWAENFCNDPAVKPVMPETAKLAEFAKKIFPKPQA

SEQ ID NO: 7495 - protein, 225 aa, Zea mays
  misc_feature (1)..(225): useful for making plants with modified plant phenotypes as described in USSN 12/139,269
  misc_feature (1)..(225): Ceres CLONE ID no. 1592057
  misc_feature (1)..(225): Utility: Useful for making plants with altered leaf shape eg curled leaves
  misc_feature (1)..(225): Utility: Useful for making smaller plants
MSEAAVRVIGLWPSPFVIRVLIALKLKHVEYEFVEEVVGSKSELLLASNPVHKKIPVLLHHGKPLSESLIIVQYIDEVWSSGAPAAILPADPYARAVQRFWAQYVDDKMHPAIRVLKGTYDGDKEQAAGQLSAALQLLEEAFAQLGQGKRYFGGDSVGYLDIALVSHVGWVKAVEKIAGVTLLDEAKVPNLVAWADRLCAHPAVVDAIPDADKFVEFSVTYGSFS

SEQ ID NO: 7496 - protein, 235 aa, Zea mays
  misc_feature (1)..(235): useful for making plants with modified plant phenotypes as described in USSN 12/139,269
  misc_feature (1)..(235): Ceres CLONE ID no. 285432
  misc_feature (1)..(235): Utility: Useful for making plants with altered leaf shape eg curled leaves
  misc_feature (1)..(235): Utility: Useful for making smaller plants
MAAGGELQLLSSWYSPYVIRAKVALGLKGLSYEFIEEDLFSKSDLLLELNPVHKKVPVLVHGGRPVCESLVIVQYVDETWAAGTGTPLLPADAHDRATARFWAAYVDDKFCKEWIKLYRSTTAEKAAEALGGVVPVVETLEQAFRECSRGKPFFGGDAVGLVDIALGSFVVWIRVVDEAAGVKLLDEAKFPALTAWAERFLAVDAVREVMPDAGRLLEHYKGFLAKRAPPSPAGY

SEQ ID NO: 7497 - protein, 234 aa, Glycine max
  misc_feature (1)..(234): useful for making plants with modified plant phenotypes as described in USSN 12/139,269
  misc_feature (1)..(234): Ceres CLONE ID no. 1103933
  misc_feature (1)..(234): Utility: Useful for making plants with altered leaf shape eg curled leaves
  misc_feature (1)..(234): Utility: Useful for making smaller plants
MSKSEDLKLLGGWFSPFALRVQIALNLKGLEYEVVEETLNPKSDLLLKSNPVHKKIPVFFHGDKVICESAIIVEYIDEAWTNVPSILPQNAYDRANARFWFAYIDEKWFTSLRSVLVAEDDEAKKPHFEQAEEGLERLEEVFNKYSEGKAYFGGDSIGFIDIGFGSFLSWMRVIEEMSGRKLLDEKKHPGLTQWAETFAADPAVKGILPETDKLVEFAKILQLKWTAAAAAAAK

SEQ ID NO: 7498 - protein, 235 aa, Triticum aestivum
  misc_feature (1)..(235): useful for making plants with modified plant phenotypes as described in USSN 12/139,269
  misc_feature (1)..(235): Ceres CLONE ID no. 1017106
  misc_feature (1)..(235): Utility: Useful for making plants with altered leaf shape eg curled leaves
  misc_feature (1)..(235): Utility: Useful for making smaller plants
  misc_feature (15)..(15): Xaa is any aa, unknown or other
  misc_feature (46)..(46): Xaa is any aa, unknown or other
MAGDGELKLLGVWTXPFVIRVRVVLNLKSLPYEYVEENLGSKSALXLGSNPVHQSVPVLLHGGRPVNESQVIVQYIDEVWAGAGPSVLPADPYERATARFWAAYVDDKVGSAWTGMLFSCKTEEERAEAVSRAVAALETLEGAFAECSKGKAFFGGDAIGFVDVVLGGYLGWFGAIDKIIGRRLIDPARTPLLARWEEQFRAADAAKGVVPDDADKMLEFFPPCSLGSPPKRSEL

SEQ ID NO: 7499 - protein, 232 aa, Zea mays
  misc_feature (1)..(232): useful for making plants with modified plant phenotypes as described in USSN 12/139,269
  misc_feature (1)..(232): Ceres CLONE ID no. 1558718
  misc_feature (1)..(232): Utility: Useful for making plants with altered leaf shape eg curled leaves
  misc_feature (1)..(232): Utility: Useful for making smaller plants
MSEAAVRVIGLWPSPFVIRVLIALKLKGVEFEFVEEVVGRKSELLLRSNPVHKKIPVLLHHGKPISESLIVVQYIDEVWSSGAPAFLPVDAHARAVQRFWAQYVDDKLPWAIRILKGTDDGGMEQAAGQLSAALQLLEEAFAQLSQGKRYFGGDSVGYLDIALVSHVGWVKAVEKIAGVTLLDKAKVPNLVAWADRLCAHPAVVDAIPDADKFVEFSVTYGSFSKPINAPAK

SEQ ID NO: 7500 - protein, 231 aa, Zea mays
  misc_feature (1)..(231): useful for making plants with modified plant phenotypes as described in USSN 12/139,269
  misc_feature (1)..(231): Ceres CLONE ID no. 986507
  misc_feature (1)..(231): Utility: Useful for making plants with altered leaf shape eg curled leaves
  misc_feature (1)..(231): Utility: Useful for making smaller plants
MAGGNDLKVLGVWTSPFVIRVRIVLNLKGLAYEYVEEDLGNKSALLLGSNPVHKSVPVLLHAGRAINESQVILQYIDEVWAGTGPAVLPADPYERAVARFWGAYIDDKVESAWLGMLFRCANEEERAAAVARAREALDALEGAFRDCSRGRPFFGGDDIGFVDAVLGGYLGWFGAVGRIIGSRLIDPARTPLLAAWEDRFRAADVAKGVVPDDLDKMLAFLQTLRAMNYAK

SEQ ID NO: 7501 - protein, 236 aa, Zea mays
  misc_feature (1)..(236): useful for making plants with modified plant phenotypes as described in USSN 12/139,269
  misc_feature (1)..(236): Ceres CLONE ID no. 1276499
  misc_feature (1)..(236): Utility: Useful for making plants with altered leaf shape eg curled leaves
  misc_feature (1)..(236): Utility: Useful for making smaller plants
MAGGGDDELKLLGAWASPFVLRVKLALSFKGLSYEDVEEDLSGGKSELLLESNPVHKKVPVLLHNGKPVCESQIIVQYIDEAFAGTGPSLLPADPHQRAVARFWGAYIDDKLLAFWLQSARAKTQEEKAEALKQALAAAENLEAAFTEISEGKPFFGGDSVGYLDVTLGALVAWVHAAEKLYGMRLFDATRTPRLSAFVERFGALGAAKAVLPDVDGLVEYAKQRQADAAAAASDS

SEQ ID NO: 7502 - protein, 235 aa, Triticum aestivum
  misc_feature (1)..(235): useful for making plants with modified plant phenotypes as described in USSN 12/139,269
  misc_feature (1)..(235): Ceres CLONE ID no. 772062
  misc_feature (1)..(235): Utility: Useful for making plants with altered leaf shape eg curled leaves
  misc_feature (1)..(235): Utility: Useful for making smaller plants
  misc_feature (62)..(62): Xaa is any aa, unknown or other
  misc_feature (64)..(64): Xaa is any aa, unknown or other
  misc_feature (114)..(114): Xaa is any aa, unknown or other
  misc_feature (124)..(124): Xaa is any aa, unknown or other
  misc_feature (127)..(127): Xaa is any aa, unknown or other
  misc_feature (129)..(129): Xaa is any aa, unknown or other
  misc_feature (150)..(150): Xaa is any aa, unknown or other
  misc_feature (159)..(159): Xaa is any aa, unknown or other
  misc_feature (183)..(183): Xaa is any aa, unknown or other
  misc_feature (198)..(198): Xaa is any aa, unknown or other
MEMPCEQPAVKLIGWLSPYVHRAEVALRLKGVPYDLLHDDMASKSDLLLAHNPVHKKVPVLXHXHRSIAESLVIVEYVDEAFPAGPPLLPSDPLARANARFWARFLDDKCWKAXWVALWAEPGXAQXAXAREAKEGLALLEAQLPEGKRXFGGDAIGLXDIAASGLARWLGVFEEMAGVRLLXEEEHPALCRWARAYXADQTAQQCLPDRDLVLAVLTPRRDMFVSTAKAMAAHK

SEQ ID NO: 7503 - protein, 239 aa, Zea mays
  misc_feature (1)..(239): useful for making plants with modified plant phenotypes as described in USSN 12/139,269
  misc_feature (1)..(239): Ceres CLONE ID no. 1061444
  misc_feature (1)..(239): Utility: Useful for making plants with altered leaf shape eg curled leaves
  misc_feature (1)..(239): Utility: Useful for making smaller plants
MEEELTLVGYWSSPFALRARFALNLKGLPYAYVEEVGLFDGKSPLLLASNPVHKRVPVLIHNGKPVPESQLIVQYVEEAFPASSPRFLPPDPHERAVARFWASYVDGELLSAWLPVYGGRTGEERAEAAGRVGAALETLERAFGECSKGKGFFGGDTVGLVDVVLGGFVGWLQTSEAMCGVRLLDAAATPLLAAWAERFRALDGVKEVMPDAQRLLEYNLMRRARLGLPLTQPPPPQHQ

SEQ ID NO: 7504 - protein, 237 aa, Zea mays
  misc_feature (1)..(237): useful for making plants with modified plant phenotypes as described in USSN 12/139,269
  misc_feature (1)..(237): Ceres CLONE ID no. 381987
  misc_feature (1)..(237): Utility: Useful for making plants with altered leaf shape eg curled leaves
  misc_feature (1)..(237): Utility: Useful for making smaller plants
MATAGGGAGHLKLLGAWPSPFVNRVRMALHLKGLEYENVEEDLTNKSDLLLASNPVHKLVPVLLHGDKPISESLVIVEYLDDAFPGAGQAVLPADPYERAVARFWAKYVDGKLHGMMVKALMGATEEERATATADALAAMDTLEGAFAECSGGKEFFAGDAPGYLDVALGGFIGWLRAWDKVGGVKLLDAGRAPRLATWAERFAALDVAKEVIPDPDHIAEFAKVLQARSAAAATSN

SEQ ID NO: 7505 - protein, 241 aa, Zea mays
  misc_feature (1)..(241): useful for making plants with modified plant phenotypes as described in USSN 12/139,269
  misc_feature (1)..(241): Ceres CLONE ID no. 373922
  misc_feature (1)..(241): Utility: Useful for making plants with altered leaf shape eg curled leaves
  misc_feature (1)..(241): Utility: Useful for making smaller plants
MGRDGGDGELKLLGLWASPFVARAKLALQIKGLSYEYVEEDLGNKSELLLSSNPVHKTVPVLIHNGTPVCESTVIVQYIDDAFAGTGPSLLPADPYQRALARFWAAYLEDKIVTPWRRFFMVKADEEKAEAMRQTVAAMDALEGGLKECSSGGGGQSPFFGGDSVGYVDVLLGGMVSWVKASEPLSGAKIIDAARTPLLAAWMERFCELDAAKAVLQDVHEVVEYARTVQARVAAATASNQ

SEQ ID NO: 7506 - DNA, 1192 bp, Arabidopsis thaliana
  misc_feature (1)..(1192): useful for making plants with modified plant phenotypes as described in USSN 12/139,269
  misc_feature (1)..(1192): Ceres CLONE ID no. 14105
  misc_feature (1)..(1192): Also known as  Ceres CDNA ID no. 23377314
caacataactcttttgcttaagcctcaaaaaattgtcattaacccaatttcccagaaacttcaaaaacagttgggggaagaagaagaagatgaaacgacgaagaacccttttataaagtctcaatctcttaatccaagatctgccctttttcagattctatctcaaagctttcctcgatcttgtgatgtattgaagccggagactgagagagatgttgtgcttcaaaggctcggttaagcggaagaagcaatccggttctgttccggtttatctgaatgtctacgatctaactcctatgaatgcttatggttattggcttggacttggtgtttttcattctggtgttgaagttcatggagttgaatatgcatttggagcacatgaatcatcaagcacaggtatttttgaagtggaaccaaagaagtgtcctggtttcacgtttaggaaatcgattcttgtggggaaaaccgacttggttgcgaaagaagttcgtgtttttatggagaaattagctgaagagtatcaaggaaacaagtaccatctcatcacaaggaactgcaaccatttttgcaatgaagtttgtcttaaacttgctcagaaatcaatccctagatgggtgaatcgacttgctcgcttaggggttctctgcaactgtgtgttaccacctcgtttgaacgaggcaaaagtgagacgagtaggaaaaggagagctttcggaaagtgagaagaagaaactaagaaaccgatcacgatcagatcctttactgtcttcttctccgtcttcatcgacacctgataatcatcgttcacacattcgagcaaaatcaagtggtaatcatccttcttcttcttcttcttcgtcttcgggttctaagaaaaatcgaagacctaaagctcaagaccagaagtcgccaagcgtaagcatcaagacttgattgttatcatcattatttgaacatttaattattgtttatgaaaaggacaaaaagtaaaaagacaagaacagaggaacatgccaagcaaagtatcaatcatacatggggcatgctcgtgctttgttctaaggttattgaaaacctttttgggtgtgtagatcatttttctttgtacaattgcttataggagagagagagaggtcatgagtatgtacaaaaagaatatgattcatatatttttctatgttttatctctc

SEQ ID NO: 7507 - protein, 240 aa, Arabidopsis thaliana
  misc_feature (1)..(240): useful for making plants with modified plant phenotypes as described in USSN 12/139,269
  misc_feature (17)..(140): Pfam Name: DUF862; Pfam Description: Eukaryotic protein of unknown function (DUF862)
  misc_feature (1)..(240): Utility: Useful for making plants with altered leaf shape eg curled leaves
MLCFKGSVKRKKQSGSVPVYLNVYDLTPMNAYGYWLGLGVFHSGVEVHGVEYAFGAHESSSTGIFEVEPKKCPGFTFRKSILVGKTDLVAKEVRVFMEKLAEEYQGNKYHLITRNCNHFCNEVCLKLAQKSIPRWVNRLARLGVLCNCVLPPRLNEAKVRRVGKGELSESEKKKLRNRSRSDPLLSSSPSSSTPDNHRSHIRAKSSGNHPSSSSSSSSGSKKNRRPKAQDQKSPSVSIKT

SEQ ID NO: 7508 - protein, 249 aa, Arabidopsis thaliana
  misc_feature (1)..(249): useful for making plants with modified plant phenotypes as described in USSN 12/139,269
  misc_feature (1)..(249): Public GI no. 20259079
  misc_feature (1)..(249): Utility: Useful for making plants with altered leaf shape eg curled leaves
MFCRNVSVRRKKNSGTVPVYLNVYDLTPMNVYGYWLGIGIYHSGLEVHGVEYGYGAHEKSSSGIFEVEPKKCPGFTFRKSILVGETEMKAKEVRSFMEKLSEEYQGNKYHLITRNCNHFCNHVSLKLTHKSIPSWVNRLARLGFLCNCVLPACLNETKVKRVGKDGKLLLEGENTKKKKRKKKIRRSRSGPLSSSSSNARLDNTPTHNRSISTGNPPLSASPSCPLRPRLPSVASGAEDQNPPSVSVKT

SEQ ID NO: 7509 - protein, 212 aa, Brassica napus
  misc_feature (1)..(212): useful for making plants with modified plant phenotypes as described in USSN 12/139,269
  misc_feature (1)..(212): Ceres CLONE ID no. 963952
  misc_feature (1)..(212): Utility: Useful for making plants with altered leaf shape eg curled leaves
MVVVNGRKKKPGLVPVYLNVYDLTPINGYAYWLGLGVYHSGVEVHGVEYGFGAHEHSTTGIFEVGPKQCPGFTFRKSILIGRTELDPQQVCAFLEKLAEGYCGNTYHLITKNCNHFCNDVCVRLTRRSIPSWVNRLARFGLFCNCVLPAELNETKVRQVRSKEEKIPEVKKLRSRSSRFPPSSSLSSSGSLNRNRRGERRRQRLPPTPPVSA

SEQ ID NO: 7510 - protein, 218 aa, Brassica napus
  misc_feature (1)..(218): useful for making plants with modified plant phenotypes as described in USSN 12/139,269
  misc_feature (1)..(218): Public GI no. 62319459
  misc_feature (1)..(218): Utility: Useful for making plants with altered leaf shape eg curled leaves
MLCRMVVVTGRKKKPGSVPVYLNVYDLTPINGYAYWLGLGIYHSGVEVHGVEYGFGAHDHSTTGIFEVEPKQCPGFTFRKSILIGRTDLDPENVRVFMEKLAEEYSGNSYHLITKNCNHFCNDVCVQLTRRSIPSWVNRLARFGLFCNCVLPAELNETKVRQVRSKEEKIPEVEKKKLRSRSSRFPPGPSLSSSGSLNRSRRGERRRQCLPPSPTVSV

SEQ ID NO: 7511 - protein, 219 aa, Glycine max
  misc_feature (1)..(219): useful for making plants with modified plant phenotypes as described in USSN 12/139,269
  misc_feature (1)..(219): Ceres CLONE ID no. 654289
  misc_feature (1)..(219): Utility: Useful for making plants with altered leaf shape eg curled leaves
MLCRKSSKNDVGSGSVPVHLNVYDLTPINGYAYWFGLGVYHSGVQVHGVEFAFGAHEYSLTGIFEGEPKRCEGFAFRKTILIGKTDMRPGEVKAVMEELAAKYRGNAYNLITKNCNHFCNDACLRLTGNPIPSWVNRLARIGFMCNCVLPVTLNSTKVRHHKMEEKQCEGEKQALATKAKKLSASNSSSSSPEGLRRGRSRNRRALPPSSPLIIGSSSS

SEQ ID NO: 7512 - protein, 217 aa, Glycine max
  misc_feature (1)..(217): useful for making plants with modified plant phenotypes as described in USSN 12/139,269
  misc_feature (1)..(217): Ceres CLONE ID no. 626552
  misc_feature (1)..(217): Utility: Useful for making plants with altered leaf shape eg curled leaves
MLCRRSSKNGVGSGSVPVHLNVYDLTPINGYAYWFGLGVYHSGVQVHDVEFAFGAHEYPSTGIFEGEPKRCEGFAFRKTILIGKTDMGPCEVRAVMEELAAEYRGNAYNLITKNCNHFCNDACLRLTGNPIPSWVNRLARIGFMCNCVLPVTLNSTKVRHHKIEDKQCEEEKQALASEPKKLNSSNSSSPKGLRRGRSRTRRALPPSSPLIIGSSSS

SEQ ID NO: 7513 - DNA, 1281 bp, Arabidopsis thaliana
  misc_feature (1)..(1281): useful for making plants with modified plant phenotypes as described in USSN 12/139,269
  misc_feature (1)..(1281): Ceres CLONE ID no. 156807
  misc_feature (1)..(1281): Also known as  Ceres CDNA ID no. 23556939
actctctctctatctctatatatcgacacaccataaaagttgttctttctctccgtttccttagcctctgcatctgggcgattttctctttctatctccctacaccttagggagtactgatcctaaactcatcatctttctatgccttcctcttttctttcacttattttcttttctatttttctttctttcttactttgcgtaaaactagcgagtcaaaaataaagacacttgcatgatcctaatataatattatatattgtaattagagaaagagagagaagagaagaaagaaagtggcaatagattcttatggattttggtataaagaaacatgaaaaaatgggtttgaccgaagaaacgttgaggacgctttttgtatgcaaccccaaatagcagcttaaagaaagcagagaggatcttcttttatttcccctctgagcaacagaagccattattcaaagaaaggcttctttaatttactcgcagggagagggaaaagagaaaaaattgaaaaactccattttcaagtcattaaaatggcatcttcttcaacaaactcaccatgcgccgcttgcaaattcctccggcgaaaatgtcaaccggaatgtgtattcgcgccctatttcccaccggaccagccacaaaaattcgcaaacgttcacaaagtgtttggagcaagtaacgtgacaaagctcctcaacgagcttcacccttcacaacgtgaagacgcagtgaactctttggcctatgaagccgacatgcgcctccgtgaccctgtctacggctgcgttggcgtcatctctctcctccaacatcagcttcgtcagcttcagatagatctcagctgtgctaaatctgagctctctaagtaccaaagcctcggtatcctcgccgccactcatcagagtcttggcatcaacttactcgccggagcagcagatggaacagccaccgccgtgagagaccactatcaccaccaccagttttttcctagagaacaaatgtttggtggcttggatgttccggccggtaacaactacgacggtgggattcttgccattggacagatcactcagtttcagcagccgagagccgccgctggagatgatggtcgccgtactgttgatcctcttgagattttagggttttggtggtgttcatcttcgtcgatcgcttggtgatgagaaaactataattttaagaaaatatttgatgtggaaaaccaaaatattttaaacgtatggtacgtctctcttaatgacattaatttcggttttt

SEQ ID NO: 7514 - protein, 214 aa, Arabidopsis thaliana
  misc_feature (1)..(214): useful for making plants with modified plant phenotypes as described in USSN 12/139,269
  misc_feature (9)..(109): Pfam Name: DUF260; Pfam Description: Protein of unknown function DUF260
  misc_feature (1)..(214): Utility: Useful for making plants with altered leaf shape eg curled leaves
MASSSTNSPCAACKFLRRKCQPECVFAPYFPPDQPQKFANVHKVFGASNVTKLLNELHPSQREDAVNSLAYEADMRLRDPVYGCVGVISLLQHQLRQLQIDLSCAKSELSKYQSLGILAATHQSLGINLLAGAADGTATAVRDHYHHHQFFPREQMFGGLDVPAGNNYDGGILAIGQITQFQQPRAAAGDDGRRTVDPLEILGFWWCSSSSIAW

SEQ ID NO: 7515 - protein, 260 aa, Zea mays
  misc_feature (1)..(260): useful for making plants with modified plant phenotypes as described in USSN 12/139,269
  misc_feature (1)..(260): Ceres CLONE ID no. 281759
  misc_feature (1)..(260): Utility: Useful for making plants with altered leaf shape eg curled leaves
MASSVPAPSGSVITVASSSSSAAAAAVCGTGSPCAACKFLRRKCQPDCVFAPYFPPDNPQKFVHVHRVFGASNVTKLLNELHPFQREDAVNSLAYEADMRLRDPVYGCVGVISILQHNLRQLQQDLARAKYELSKYQAAAAASASTAPTGPQAMAEFIGNAMPNGAHNFINIGHSAALGSLGGSASVFGQEQFGNAQMLSRSYDGGEPIARLGINGGGYEFGYSTAMGGSGAVSGLGTLGISPFLKSGTAGGDEKPNGGQ

SEQ ID NO: 7516 - protein, 178 aa, Parthenium argentatum
  misc_feature (1)..(178): useful for making plants with modified plant phenotypes as described in USSN 12/139,269
  misc_feature (1)..(178): Ceres CLONE ID no. 1603612
  misc_feature (1)..(178): Utility: Useful for making plants with altered leaf shape eg curled leaves
  misc_feature (134)..(134): Xaa is any aa, unknown or other
  misc_feature (135)..(135): Xaa is any aa, unknown or other
  misc_feature (141)..(141): Xaa is any aa, unknown or other
MPPGHSPCASCKLLRRRCAKDCIFAPYFPSNDPHKFAIVHKVFGASNVSKMLQELEVHQRGDAVSSLVYEANARMRDPVYGCVGAISYLQKEVSQLQKQLAMAQAEILCIQMQQEPLGPAPTLAASVINSLVPXXPTRTSXVTDDVIFRGSSDDVSYPCLHNTTNHHHHNDQHFNFNF

SEQ ID NO: 7517 - protein, 182 aa, Glycine max
  misc_feature (1)..(182): useful for making plants with modified plant phenotypes as described in USSN 12/139,269
  misc_feature (1)..(182): Ceres CLONE ID no. 592749
  misc_feature (1)..(182): Utility: Useful for making plants with altered leaf shape eg curled leaves
MKGYEPRSSSSCAACKFLKRRCIPNCIFAPYFRSDECKKFAKVHKVFGASNVSKILVEVPEEQREDTVNSLAYEAEARLRDPVYGCIGAIALLQRKMVELQHDLAIAKDRLARYTAAATTATATTTTSDALINGHVSLPPFPDFFTCADNFNNDNFCHTSSSQSSFTRHETVDDFIQIPYIF

SEQ ID NO: 7518 - DNA, 1218 bp, Zea mays
  misc_feature (1)..(1218): useful for making plants with modified plant phenotypes as described in USSN 12/139,269
  misc_feature (1)..(1218): Ceres CLONE ID no. 228787
  misc_feature (1)..(1218): Also known as  Ceres CDNA ID no. 23777556
acatcctctttcagttccctctctggatctcttcctgaagagaggcactgccacaccaccacgccacccatgctcaacatgatgaccgatctgagctgcgggccgtcgtccaaggcgaaaggagggcagccggcagcgacgacgggctccggcggcgacaggcaggggaggggcaagatcgagatcaagcgcatcgagaacacgacgaaccggcaggtcaccttctgcaagcgccgcaacggcctgctcaagaaggcgtacgagctctcggtgctctgcgacgccgaggtcgcgctcgtcgtcttctccagccgcggccgcctctacgagtacgccaacaacagtgtgaagtccaccattgagaggtacaagaaggccaacagtgacacctccaactctggcacagttgcagaagtcaatgctcagcactaccagcaggagtcctccaagctgcgccaggcgatcgatagcttgcaaaacgcaaacaggaccatagtgggagattcaatccacaccatgggcctcagggagcttaagcagatggagggcaagctggagaaggccataaacaagattagagctagaaagaatgagctcttgtatgctgaagttgaatatatgcaaaaaagggagatggatctgcagactgacaacatgtacctgaggagcaagatcgccgagaataatgaaacggggcagccagcgatgaacatgattggagtgccgtcgacgagcgagtacgatcacatggccccttttgttgactcgagaaactttcttcaggtgaacatgcagcagcagcctcagcactactcccatcagctgcaaccaacgaccctccaactcggatgatgaaattaagaatcttcggccaacaatccatgcatccacgcaaggacgcagtaaatcatgtgtccaactcagataaaaatctactctagcgtttgtataattattaataatcgtgactagtaaactgttatatatatagccatatgtgtgtggcgcctacatatatgtcatgtggctgtacggcgagttttttttcacaagcgtttgcagcagcatttggtgttgctcatccatcaattaatcgcaagaaattaaacctgtcaccaccgtgtgtgcatttgtacgtgttaatgcagttgctgtatccgttaattgtaccctccatcagataaacgcgggtgcgcgtatgcatacttatttatgtgt

SEQ ID NO: 7519 - protein, 260 aa, Zea mays
  misc_feature (1)..(260): useful for making plants with modified plant phenotypes as described in USSN 12/139,269
  misc_feature (40)..(90): Pfam Name: SRF-TF; Pfam Description: SRF-type transcription factor (DNA-binding and dimerisation domain)
  misc_feature (105)..(204): Pfam Name: K-box; Pfam Description: K-box region
  misc_feature (1)..(260): Utility: Useful for making plants with altered leaf shape eg curled leaves
MLNMMTDLSCGPSSKAKGGQPAATTGSGGDRQGRGKIEIKRIENTTNRQVTFCKRRNGLLKKAYELSVLCDAEVALVVFSSRGRLYEYANNSVKSTIERYKKANSDTSNSGTVAEVNAQHYQQESSKLRQAIDSLQNANRTIVGDSIHTMGLRELKQMEGKLEKAINKIRARKNELLYAEVEYMQKREMDLQTDNMYLRSKIAENNETGQPAMNMIGVPSTSEYDHMAPFVDSRNFLQVNMQQQPQHYSHQLQPTTLQLG

SEQ ID NO: 7520 - protein, 259 aa, Zea mays
  misc_feature (1)..(259): useful for making plants with modified plant phenotypes as described in USSN 12/139,269
  misc_feature (1)..(259): Ceres CLONE ID no. 219824
  misc_feature (1)..(259): Utility: Useful for making plants with altered leaf shape eg curled leaves
MLNMMTDLSCGPSSKVKEQVAAAPTGSGDRQGQGRGKIEIKRIENTTNRQVTFCKRRNGLLKKAYELSVLCDAEVALVVFSSRGRLYEYANNSVKSTIERYKKANSDSSNSGTVAEVNAQYYQQESSKLRQMIHSLQNANTRNIVGDSIHTMGLRDLKQMEGKLEKAISKIRARKNELLYAEVDYMQKREMDLQTDNMYLTSKIAESNETGQPAMHMMGVPPPTSEYDHMAPFDSRNFLQVSMPQHYSHQLQPTTLQLG

SEQ ID NO: 7521 - protein, 259 aa, Zea mays
  misc_feature (1)..(259): useful for making plants with modified plant phenotypes as described in USSN 12/139,269
  misc_feature (1)..(259): Ceres CLONE ID no. 266080
  misc_feature (1)..(259): Utility: Useful for making plants with altered leaf shape eg curled leaves
MLNMMTDLSCGPSSKVKEQVAAAPTGSGDRQGQGRGKIEIKRIENTTNRQVTFCKRRNGLLKKAYELSVLCDAEVALVVFSSRGRLYEYANNSVKSTIERYKKANSDSSNSGTVAEVNAQYYQQESSKLRQMIHSLQNANTRNIVGDSIHTMGLRDLKQMEGKLEKAIIKIRARKNELLYAEVDYMQKREMDLQTDNMYLRSKIAESNETGQPAMHMTMGAPPTSEYDHMAPFDSRNFLQVSMPQHYSHQLQPTTLQLG

SEQ ID NO: 7522 - protein, 273 aa, Zea mays
  misc_feature (1)..(273): useful for making plants with modified plant phenotypes as described in USSN 12/139,269
  misc_feature (1)..(273): Public GI no. 29372746
  misc_feature (1)..(273): Utility: Useful for making plants with altered leaf shape eg curled leaves
FPADREALPHHHHPMLNMMTDLSCGPSSKVKEQVAAAPTGSGDRQGQGRGKIEIKRIENTTNRQVTFCKRRNGLLKKAYELSVLCDAEVALVVFSSRGRLYEYANNSVKSTIERYKKANSDSSNSGTVAEVNAQYYQQESSKLRQMIHSLQNANTRNIVGDSIHTMGLRDLKQMEGKLEKAISKIRARKNELLYAEVDYMQKREMDLQTDNMYLTSKIAESNETGQPAMHMMGVPPPTSEYDHMAPFDSRNFLQVSMPQHYSHQLQPTTLQLG

SEQ ID NO: 7523 - protein, 259 aa, Zea mays; identical to SEQ ID NO: 7521
  misc_feature (1)..(259): useful for making plants with modified plant phenotypes as described in USSN 12/139,269
  misc_feature (1)..(259): Public GI no. 2529340
  misc_feature (1)..(259): Utility: Useful for making plants with altered leaf shape eg curled leaves

SEQ ID NO: 7524 - protein, 236 aa, Zea mays
  misc_feature (1)..(236): useful for making plants with modified plant phenotypes as described in USSN 12/139,269
  misc_feature (1)..(236): Public GI no. 2130078
  misc_feature (1)..(236): Utility: Useful for making plants with altered leaf shape eg curled leaves
MGRGKIEIKRIENTTNRQVTFCKRRNGLLKKAYELSVLCDAEVALIVFSSRGRLYEYANNSVKSTVERYKKANSDTSNSGTVAEVNAQHYQQESSKLRQQISSLQNANSRTIVGDSINTMSLRDLKQVENRLEKGIAKIRARKNELLYAEVEYMQKREVELQNDNMYLRSKVVENERGQQPLNMMGAASTSEYDHMVNNPYDSRNFLQVNIMQQPQHYAHQLQPTTLQLGQQPAFN

SEQ ID NO: 7525 - protein, 247 aa, Zea mays
  misc_feature (1)..(247): useful for making plants with modified plant phenotypes as described in USSN 12/139,269
  misc_feature (1)..(247): Public GI no. 34903684
  misc_feature (1)..(247): Utility: Useful for making plants with altered leaf shape eg curled leaves
MGRGKIEIKRIENTTNRQVTFCKRRNGLLKKAYELSVLCDAEVALIVFSSRGRLYEYANNSVKSTVERYKKANSDTSNSGTVAEVNAQHYQQESSKLRQQISSLQNANSRTIVGDSINTMSLRDLKQVENRLEKGIAKIRARKNELLYAEVEYMQKREVELQNDNMYLRSKVVENERGQQPLNMMGAASTSEYDHMVNNPYDSRNFLQVNIMQQPQHYAHQLQPTTLQLGSRPSISFGVDTVRTHVR

SEQ ID NO: 7526 - protein, 236 aa, Glycine max
  misc_feature (1)..(236): useful for making plants with modified plant phenotypes as described in USSN 12/139,269
  misc_feature (1)..(236): Ceres CLONE ID no. 513630
  misc_feature (1)..(236): Utility: Useful for making plants with altered leaf shape eg curled leaves
MSVSPQRKMGRGKIEIKRIENTTNRQVTFCKRRNGLLKKAYELSVLCDAEVALIVFSSRGRLYEYANNSVKATIERYKKASSDSSGAGSASEANAQFYQQEADKLRQQISNLQNNNRQMMGDSLGSLTAKDLKNLETKLEKGISRIRSKKNELLFAEIEYMQKREIDLHNNNQLLRAKIAESERNHHNMAVLPGGSNYDSMQSSQQQFDSRGYFQVTGLQPNNQYARQDQMSLQLV

SEQ ID NO: 7527 - protein, 230 aa, Arabidopsis thaliana; identical to SEQ ID NO: 5279
  misc_feature (1)..(230): useful for making plants with modified plant phenotypes as described in USSN 12/139,269
  misc_feature (1)..(230): Ceres CLONE ID no. 32791
  misc_feature (1)..(230): Utility: Useful for making plants with altered leaf shape eg curled leaves

SEQ ID NO: 7528 - protein, 230 aa, Arabidopsis thaliana; identical to SEQ ID NO: 5279
  misc_feature (1)..(230): useful for making plants with modified plant phenotypes as described in USSN 12/139,269
  misc_feature (1)..(230): Ceres CLONE ID no. 1010174
  misc_feature (1)..(230): Utility: Useful for making plants with altered leaf shape eg curled leaves

SEQ ID NO: 7529 - protein, 228 aa, Glycine max
  misc_feature (1)..(228): useful for making plants with modified plant phenotypes as described in USSN 12/139,269
  misc_feature (1)..(228): Ceres CLONE ID no. 1046745
  misc_feature (1)..(228): Utility: Useful for making plants with altered leaf shape eg curled leaves
  misc_feature (67)..(67): Xaa is any aa, unknown or other
  misc_feature (96)..(96): Xaa is any aa, unknown or other
MGRGKIEIKRIENTTNRQVTFCKRRNGLLKKAYELSVLCDAEVALVVFSTRGRLYEYANNSVRATIXRYKKANAAASNAESVSEANTQFYQQESSXLRRQIRDIQNLNRHILGEALGSLSLKELKNLEGRLEKGLSRVRSRKHETLFADIEFMQKREIELQNHNNFLRAKIAENERAQQRQQDMIPGTECESTIPNSQSYDRNFFPVNLIDSNNNQYSRQDQTALQLV

SEQ ID NO: 7530 - protein, 265 aa, Brassica napus; identical to SEQ ID NO: 2900
  misc_feature (1)..(265): useful for making plants with modified plant phenotypes as described in USSN 12/139,269
  misc_feature (1)..(265): Ceres CLONE ID no. 1251169
  misc_feature (1)..(265): Utility: Useful for making plants with altered leaf shape eg curled leaves

SEQ ID NO: 7531 - DNA, 1334 bp, Glycine max
  misc_feature (1)..(1334): useful for making plants with modified plant phenotypes as described in USSN 12/139,269
  misc_feature (1)..(1334): Ceres CLONE ID no. 537272
  misc_feature (1)..(1334): Also known as  Ceres CDNA ID no. 23699533
atagtgagtgagagagagaaacaaaaagaaaagagagagctctttcattttcattcctttcaagggtttaacacaaacttcttattacttttgaaactatgatagggtttggagggaacagttgcagtgagctttctgagatggacatgacgaacatggaaactaataggaagtttctttctctgcctctcagtaacaacaacaactctggtgataatagaagggtacctgtcactagcaatagcatcgctcaggaacatcactacagccaccaccacaaccccaccgacacttgcagtgtgagggataaaatcatggcacatcctctttttcctcgtctcttatcctcttacctcaattgcctcaaggttggagcacctcctgaagtggtggctagcttagaggagtcatatgcaaaatatgagtccttcaatgcatcatcaggaaggataggaggtggttcaataggtgaagatccagctctggaccagttcatggaggcttactgtgagatgctcattaagtatgagcaagagcttacaaaacccttcaaagaagccatgcttttcttctcaagaattgagtgccagctcaaagccctagcagtttcatcagattttggtcaaagtgaaacatcttcaaagaatgaggttgatgttcatgaaaacaacctagattctcaagctgaagaccgggaactcaaagtccagcttttgcgcaagtatagtggatatctagggagcctcaagaaggaatttttgaagaagaaaaagaatggaaagttgccaaaggaagctcggcaacagctacttgattggtggaacaggcattataaatggccatacccttcggaatctcaaaagcaggcacttgcagaatccacaggcctagatatgaaacagatcaacaactggttcatcaatcagagaaaacgccattggaagccttctgaggatatgcaatttgccgtgatggatgcaactaactactacatggaaaatgttatgtgcaagccatttcccatggatagcatgcctatgcttctttaactcaatcctctaccactagaatatccaaaagctgagccgaaaaccctatctttttttaagttgcctaggtacccaagttgctataatgtcattgatgcatgttttactttaaaattgtagaaagcaggatgaaaattctaccttattatccctgaactgcaatctgtaactctaagtgagcgggaatctaactagctatatactctattatctacactgtttgtgcagatcactagagatgtcgtgtatgtgtagtttcctaatttaatgaatataatttgtttt

SEQ ID NO: 7532 - protein, 316 aa, Glycine max
  misc_feature (1)..(316): useful for making plants with modified plant phenotypes as described in USSN 12/139,269
  misc_feature (66)..(110): Pfam Name: KNOX1; Pfam Description: KNOX1 domain
  misc_feature (119)..(170): Pfam Name: KNOX2; Pfam Description: KNOX2 domain
  misc_feature (200)..(221): Pfam Name: ELK; Pfam Description: ELK domain
  misc_feature (231)..(282): Pfam Name: Homeobox; Pfam Description: Homeobox domain
  misc_feature (1)..(316): Utility: Useful for making plants with altered leaf shape eg curled leaves
  misc_feature (1)..(316): Utility: Useful for making plants with increased biomass and foliage
  misc_feature (1)..(316): Utility: Useful for making smaller plants
MIGFGGNSCSELSEMDMTNMETNRKFLSLPLSNNNNSGDNRRVPVTSNSIAQEHHYSHHHNPTDTCSVRDKIMAHPLFPRLLSSYLNCLKVGAPPEVVASLEESYAKYESFNASSGRIGGGSIGEDPALDQFMEAYCEMLIKYEQELTKPFKEAMLFFSRIECQLKALAVSSDFGQSETSSKNEVDVHENNLDSQAEDRELKVQLLRKYSGYLGSLKKEFLKKKKNGKLPKEARQQLLDWWNRHYKWPYPSESQKQALAESTGLDMKQINNWFINQRKRHWKPSEDMQFAVMDATNYYMENVMCKPFPMDSMPMLL

SEQ ID NO: 7533 - protein, 178 aa, Glycine max
  misc_feature (1)..(178): useful for making plants with modified plant phenotypes as described in USSN 12/139,269
  misc_feature (1)..(178): Ceres CLONE ID no. 625922
  misc_feature (1)..(178): Utility: Useful for making plants with altered leaf shape eg curled leaves
  misc_feature (1)..(178): Utility: Useful for making plants with increased biomass and foliage
  misc_feature (1)..(178): Utility: Useful for making smaller plants
MLIKYEQELTKPFKEAMLFFSRIECQLKALAVSSDFGQSETSSQNEVDVHENNLDSQAEDRELKVQLLRKYSGYLGSLKKEFLKKKKNGKLPKEARQQLLDWWNRHYKWPYPSESQKQALAESTGLDLKQINNWFINQRKRHWKPSEDMQFAVMDATNYYMENVMCKPFPMDGMPMLL

SEQ ID NO: 7534 - protein, 362 aa, Glycine max
  misc_feature (1)..(362): useful for making plants with modified plant phenotypes as described in USSN 12/139,269
  misc_feature (1)..(362): Public GI no. 20977642
  misc_feature (1)..(362): Utility: Useful for making plants with altered leaf shape eg curled leaves
  misc_feature (1)..(362): Utility: Useful for making plants with increased biomass and foliage
  misc_feature (1)..(362): Utility: Useful for making smaller plants
MESDGDGGGTSSCLMSFGDTTNNINNNSSNNNNSNNNIGSLCLPPNPPGAYNTTTNNNNLIFSDHHPSAMMLEDNNININDGVGLAFMNPSSSVKAKIMSHPHYPRLLSAYLNCQKIGAPPEVVERLEEACRASVVAAMSSCSGGAGTSDGSGGGMNMIIGQDPALDQFMEAYCEMLIKYEQELSKPFKEAMLFLSRIESQFKAISISTSDSAGGEGGMDKNGSSEEEVDVNNNLIDPQAEDRELKGQLLRKYSGYLGSLKQEFMKKRKKGKLPKEARQQLLDWWTRHYKWPYPSEAQKLALAESTGLDQKQINNWFINQRKRHWKPSEDMQFVVMDAAHPHYFMENMNILGNPYPMDVSLL

SEQ ID NO: 7535 - protein, 286 aa, Arabidopsis thaliana; identical to SEQ ID NO: 5388
  misc_feature (1)..(286): useful for making plants with modified plant phenotypes as described in USSN 12/139,269
  misc_feature (1)..(286): Ceres CLONE ID no. 3000
  misc_feature (1)..(286): Utility: Useful for making plants with altered leaf shape eg curled leaves
  misc_feature (1)..(286): Utility: Useful for making plants with increased biomass and foliage
  misc_feature (1)..(286): Utility: Useful for making smaller plants

SEQ ID NO: 7536 - protein, 373 aa, Arabidopsis thaliana
  misc_feature (1)..(373): useful for making plants with modified plant phenotypes as described in USSN 12/139,269
  misc_feature (1)..(373): Public GI no. 55276120
  misc_feature (1)..(373): Utility: Useful for making plants with altered leaf shape eg curled leaves
  misc_feature (1)..(373): Utility: Useful for making plants with increased biomass and foliage
  misc_feature (1)..(373): Utility: Useful for making smaller plants
MEGGGGDGGSSTTSCMMAFGDNSNGLCPMMMMTPLMSSSSSAHHQHPHHHHRANEGDSSISNTLFLPLPPTNNQGHNRIHSNASGSSSMIIDDHNRNHNNNTVTATGCYFMDNNDGSSSSVKAKIMAHPHYHRLLAAYANCQKVGAPPEVVARLEEACASAASIAPANTGCIGEDPALDQFMEAYCEMLTKYEQELSKPLKEAMLFLQRVECQFKALTLSSPISGCGDGNDRNVSSEEEVDVNNNFIDPQAEDQELKGQLLRRYSGYLGSLKQEFMKKRKKGKLPKEARQQLLDWWSRHYKWPYPSESQKLALAESTGLDQKQINNWFINQRKRHWKPSEDMQFVVMDAGHPHYYMDNVLGNPFPMDISPTLL

SEQ ID NO: 7537 - protein, 342 aa, Arabidopsis thaliana
  misc_feature (1)..(342): useful for making plants with modified plant phenotypes as described in USSN 12/139,269
  misc_feature (1)..(342): Public GI no. 7446291
  misc_feature (1)..(342): Utility: Useful for making plants with altered leaf shape eg curled leaves
  misc_feature (1)..(342): Utility: Useful for making plants with increased biomass and foliage
  misc_feature (1)..(342): Utility: Useful for making smaller plants
MGGGGSSGNTSSCLMGYGDDNNNNNSGNAALCPPPMMMPPPPINNNNGESSNNIGGNNNNNILFLPFMANNNNNPHEDANCSSSSSIKSKIMAHPHYPRLLSAYVNCQKIGAPPEVVARLEEVCATSATIGRNSGGIIGEDPALDQFMEAYCEMLTKYEQELSKPFKEAMVFLSRIECQFKALTLTSSSESVAALGEAIDRNGSSEEEVDVNNGFIDPQAEDQELKGQLLRKYSGYLGSLKQEFMKKRKKGKLPKEARQQLLDWWTRHYKWPYPSESQKLALAESTGLDQKQINNWFINQRKRHWKPSEDMQFVVMDAAHPHYYMDNVLGNPFPMDITPTLL

SEQ ID NO: 7538 - protein, 343 aa, Arabidopsis thaliana
  misc_feature (1)..(343): useful for making plants with modified plant phenotypes as described in USSN 12/139,269
  misc_feature (1)..(343): Public GI no. 27413549
  misc_feature (1)..(343): Utility: Useful for making plants with altered leaf shape eg curled leaves
  misc_feature (1)..(343): Utility: Useful for making plants with increased biomass and foliage
  misc_feature (1)..(343): Utility: Useful for making smaller plants
MEGGGSSGNTSCLMGYNGDDNNNNSGNAALCPPPMMMMMMPPPINNNNAESSNNIGGNNNNNILFLPFMDNNNNNPHEDANCSSTSIKSKIMAHPHYPRLLSAYVNCQKIGAPPEVVARLEEVCATSATIGRNSGGIIGEDPALDQFMEAYCEMLTKYEQELSKPFKEAMVFLSRIECQFKALTLTSSSESVAALGEAIDRNGNGSSEEVDVNNGFIDLQAEDQELKGQLLRKYSGYLGSLKQEFMKKRKKGKLPKEARQQLLDWWTRHYKWPYPSESQKLALAESTGLDQKQINNWFINQRKRHWKPSEDMQFVVMDAAHPHYYMDNVLGNPFPMDITPTLL

SEQ ID NO: 7539 - protein, 361 aa, Arabidopsis thaliana
  misc_feature (1)..(361): useful for making plants with modified plant phenotypes as described in USSN 12/139,269
  misc_feature (1)..(361): Public GI no. 54042995
  misc_feature (1)..(361): Utility: Useful for making plants with altered leaf shape eg curled leaves
  misc_feature (1)..(361): Utility: Useful for making plants with increased biomass and foliage
  misc_feature (1)..(361): Utility: Useful for making smaller plants
MEGGDGGSSTTSCMMAFGDNSNGLCPMMMTPLMSSSSAHHHHRANEGDSSVSNTLFLPLPPTNNQGHNRIHSNASGSSSMIIDDHNHNNTVTATGCYFMDNNDGSSSSVKAKIMAHPHYHRLLAAYANCQKVGAPPEVVARLEEACASAASMAPANTGCIGEDPALDQFMEAYCEMLTKYEQELSKPLKEAMLFLQRVECQFKALTVSSPISGCGDGNDRNVSSEEEVDVNNNFIDPQAEDQELKGQLLRRYSGYLGSLKQEFMKKRKKGKLPKEARQQLLDWWSRHYKWPYPSESQKLALAESTGLDQKQINNWFINQRKRHWKPSEDMQFVVMDAGHPHYYMDNVLGNPFPMDISPTLL

SEQ ID NO: 7540 - protein, 347 aa, Arabidopsis thaliana
  misc_feature (1)..(347): useful for making plants with modified plant phenotypes as described in USSN 12/139,269
  misc_feature (1)..(347): Public GI no. 22074785
  misc_feature (1)..(347): Utility: Useful for making plants with altered leaf shape eg curled leaves
  misc_feature (1)..(347): Utility: Useful for making plants with increased biomass and foliage
  misc_feature (1)..(347): Utility: Useful for making smaller plants
MEGGGNSSGNNTSSLMAYGDHENNNNAICPPMMMMMMPPPPLSITNTSNNGESSSNNNNNILFLPFMENNSNTIHEDGNSCSSNIKAKIMAHPHYPRLLAAYINCQKIGAPPEVVARLEEVCATSAHMGRNGGGGGGGGNNVIGEDPALDQFMEAYCEMLTKYEQELSKPFKEAMVFLSRIECQFKALTLASTSESVAAFGEAMDRNGSSEEEVDVNNSLVDPQAEDRELKGQLLRKYSGYLGSLKQEFMKKRKKGKLPKEARQQLLDWWTRHYKWPYPSESQKLALAESTGLDQKQINNWFINQRKRHWKPSEDMQFVVMDAAHPHYYIDNVLGNPFPMDMTPTLL

SEQ ID NO: 7541 - protein, 355 aa, Arabidopsis thaliana
  misc_feature (1)..(355): useful for making plants with modified plant phenotypes as described in USSN 12/139,269
  misc_feature (1)..(355): Public GI no. 6016221
  misc_feature (1)..(355): Utility: Useful for making plants with altered leaf shape eg curled leaves
  misc_feature (1)..(355): Utility: Useful for making plants with increased biomass and foliage
  misc_feature (1)..(355): Utility: Useful for making smaller plants
MEGGSSGNTSTSCLMMMGYGDHENNNNNNGNGNGNGNGNVTICAPPMMMMMPPPPPSLTNNNNAETSNNNILFLPFMDNNNNNNPQEDNNSSSSSIKSKIMAHPHYHRLLTAYLNCQKIGAPPEVVARLEEICATSATMGRSSSSSGGGIIGEDPALDQFMEAYCEMLTKYEQELSKPFKEAMVFLSRIECQFKALTLAPNSSHESALGEAMDRNGSSDEEVDVNNSFIDPQAEDRELKGQLLRKYSGYLGSLKQEFMKKRKKGKLPKEARQQLVDWWLRHIKWPYPSESQKLALAESTGLDQKQINNWFINQRKRHWKPSEDMQFVVMDAAHPHYYMDNVLANHFPMDMTPSLL

SEQ ID NO: 7542 - protein, 194 aa, Triticum aestivum; identical to SEQ ID NO: 5392
  misc_feature (1)..(194): useful for making plants with modified plant phenotypes as described in USSN 12/139,269
  misc_feature (1)..(194): Ceres CLONE ID no. 1250120
  misc_feature (1)..(194): Utility: Useful for making plants with altered leaf shape eg curled leaves
  misc_feature (1)..(194): Utility: Useful for making plants with increased biomass and foliage
  misc_feature (1)..(194): Utility: Useful for making smaller plants

SEQ ID NO: 7543 - protein, 351 aa, Triticum aestivum
  misc_feature (1)..(351): useful for making plants with modified plant phenotypes as described in USSN 12/139,269
  misc_feature (1)..(351): Public GI no. 18389212
  misc_feature (1)..(351): Utility: Useful for making plants with altered leaf shape eg curled leaves
  misc_feature (1)..(351): Utility: Useful for making plants with increased biomass and foliage
  misc_feature (1)..(351): Utility: Useful for making smaller plants
MEGGGGSSSNSCMIGFGENTSSNNGFCPMTMMMMPPPSMASSHPNGNTLFFPLPSTNNSHQGLNHRTSASTMLEDQHNNNTITSTGYYFMDGNDNDSVKAKIMAHPYYHKLLAAYINCQKIGAPPEVAVKLEEACASAATMGRNSVSRIGEDPALDQFMEAYCEMLSKYEQELSKPFREAMLFLSRIECQFKALTLSSSDSACGEAMDRHGSSEEEIDVDNSLIDPQAEDRELKGQLLRKYSGYLGSLKQEFMKKRKKGKLPKEARQQLLDWWSRHYKWPYPSESQKLALAEQTGLDQKQINNWFINQRKRHWKPSEDMQFVVMDAAHPGHYYMDNVLGNPFAMDILPTLL

SEQ ID NO: 7544 - protein, 193 aa, Zea mays
  misc_feature (1)..(193): useful for making plants with modified plant phenotypes as described in USSN 12/139,269
  misc_feature (1)..(193): Ceres CLONE ID no. 239250
  misc_feature (1)..(193): Utility: Useful for making plants with altered leaf shape eg curled leaves
  misc_feature (1)..(193): Utility: Useful for making plants with increased biomass and foliage
  misc_feature (1)..(193): Utility: Useful for making smaller plants
MEAYHEMLVKFREELTRPLQEAMEFMRRVESQLNSLSISGRSLRNILSSGSSEEDQEGSGGETELPEVDAHGVDQELKHHLLKKYSGYLSSLKQELSKKKKKGKLPKEARQQLLSWWDQHYKWPYPSETQKVALAESTGLDLKQINNWFINQRKRHWKPSEEMHHLMMDGYHTTNAFYMDGHFINDGGLYRLG

SEQ ID NO: 7545 - protein, 354 aa, Zea mays
  misc_feature (1)..(354): useful for making plants with modified plant phenotypes as described in USSN 12/139,269
  misc_feature (1)..(354): Public GI no. 4098240
  misc_feature (1)..(354): Utility: Useful for making plants with altered leaf shape eg curled leaves
  misc_feature (1)..(354): Utility: Useful for making plants with increased biomass and foliage
  misc_feature (1)..(354): Utility: Useful for making smaller plants
MEGGSSGNTSTSCLMMMGYGDHENNNNNNGNGNGNGNGNVTICAPPMMMMMPPPPPSLTNNNNAETSSNNILFLPFMDNNNNNPQEDNNSSSSSIKSKIMLNPHYHRLLTAYLNCQKIGAPPEVVARLEEICATSATMGRSSSSSGGGIIGEDPALDQFMEAYCEMLTKYEQELSKPFKEAMVFLSRIECQFKALTLAPNSSHESALGEAMDRNGSSDEEVDVNNSFIDPQAEDRELKGQLLRKYSGYLGSLKQEFMKKRKKGKLPKEARQQLVDWWLRHIKWPYPSESQKLALAESTGLDQKQINNWFINQRKRHWKPSEDMQFVVMDAAHPHYYMDNVLANHFPMDMTPSLL

SEQ ID NO: 7546 - protein, 358 aa, Zea mays
  misc_feature (1)..(358): useful for making plants with modified plant phenotypes as described in USSN 12/139,269
  misc_feature (1)..(358): Public GI no. 57116572
  misc_feature (1)..(358): Utility: Useful for making plants with altered leaf shape eg curled leaves
  misc_feature (1)..(358): Utility: Useful for making plants with increased biomass and foliage
  misc_feature (1)..(358): Utility: Useful for making smaller plants
MEGSAGNMNMTSSFKGANSYLGFGDNVNGFCPMMMMMPANNPNGDCSQPIFQPLPAANQQGINRNSSSAAACGGSMMPEHQSNTSTGYYFMEGDGDAGGGSVKSKIMAHPHYPRLLAAYVNCQKIGAPPEVVAKLEEACASTITIGGRNERSCVGEDPALDQFMEAYCEMLTKYEQELSKPFKEAMLFLSRIECQFKALTLSHSSDSGACGEAVLERNGSSEEEFDVNNSFIDPQAEDRELKGQLLRRYSGYLGNLKQEFMKKRKKGKLPKEARQQLLDWWSRHYKWPYPSESQKLALAESTGLDQKQINNWFINQRKRHWKPSEDMQFVVMDATHPHYYMDNFMGTPFPMDISPSFL

SEQ ID NO: 7547 - protein, 356 aa, Zea mays
  misc_feature (1)..(356): useful for making plants with modified plant phenotypes as described in USSN 12/139,269
  misc_feature (1)..(356): Public GI no. 57116570
  misc_feature (1)..(356): Utility: Useful for making plants with altered leaf shape eg curled leaves
  misc_feature (1)..(356): Utility: Useful for making plants with increased biomass and foliage
  misc_feature (1)..(356): Utility: Useful for making smaller plants
GSAGNVNMTSSFKGANSYMGFGDNVNGLCPMMMMMPANDPNGDCSQPLFLPLPAANQQGINRNSSSAAACGGSMMPEHQSNTSTGYYFMEGDGVAGGGSVKSKIMAHPHYPRLLAAYVNCQKIGAPPEVVAKLEEACASTITIGGRNERSCVGEDPALDQFMEAYCEMLTKYEQELSKPFKEAMLFLSRIECQFKALTLSHSSDSGACGEAVMERNGSSEEEFDVNNSFIDPQAEDRELKGQLLRRYSGYLGNLKQEFMKKRKKGKLPKEARQQLLDWWSRHYKWPYPSESQKLALAESTGLDQKQINNWFINQRKRHWKPSEDMQFVVMDATHPHYYMDNFIGTPFPMDISPSFL

SEQ ID NO: 7548 - DNA, 1121 bp, Glycine max
  misc_feature (1)..(1121): useful for making plants with modified plant phenotypes as described in USSN 12/139,269
  misc_feature (1)..(1121): Ceres CLONE ID no. 608818
  misc_feature (1)..(1121): Also known as  Ceres CDNA ID no. 23705833
  misc_feature (820)..(820): r is g or a
  misc_feature (1101)..(1101): r is g or a
  misc_feature (1110)..(1110): y is t/u or c
cttaacatttccctaaacataactcacacacccctcttctctagggtttcaatttcaccatgtttccctttctcaaattagggttccggcgagcatggccgacggtccggcgagtccaggcggcggtagccacgagagcggcgagcacagccctcgctctaacgtgcgcgagcaggacaggtacctccccatcgctaacataagccgcatcatgaagaaggcactacctgcgaacggtaaaatcgccaaggacgccaaagagaccgttcaggaatgcgtatccgagttcatcagtttcatcaccagcgaggcctctgataagtgtcagagggaaaagagaaagactattaacggtgatgatttgctctgggccatggccactcttggttttgaggattatatcgatcctcttaaaatttacctcactagatacagagagatggagggtgatacgaagggttcagccaagggcggagactcatcttctaagaaagatgttcagccaagtcctaatgctcagcttgctcatcaaggttctttctcacaaggtgttagttacacaatttctcagggtcaacatatgatggttccaatgcaaggcccggagtaggtatcaagtttattaaccctcctgttgtaacgtatgttttccacgccagttaccaagtgctcacggcatattgaatgtctttttatgttatgtgaatactgacataggagatggttcttgtgtcctttttttttaaaaaaaaaagtaaggtttgtatattatctttggagtcgaattattatttgaaagttattatattgtaaatcctaragccctgttgtctgaatccatcaggcggcttggcaaagaccgagattttaggactgattgtaagcataaacccgaatattcttttcctaatttctttgtgcaataatgtatgaaaaaggctcgagcttcttttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaarttttttttyccccccccccc

SEQ ID NO: 7549 - protein, 171 aa, Glycine max
  misc_feature (1)..(171): useful for making plants with modified plant phenotypes as described in USSN 12/139,269
  misc_feature (29)..(94): Pfam Name: CBFD_NFYB_HMF; Pfam Description: Histone-like transcription factor (CBF/NF-Y) and archaeal histone
  misc_feature (1)..(171): Utility: Useful for making plants with altered leaf shape eg curled leaves
  misc_feature (1)..(171): Utility: Useful for making smaller plants
MADGPASPGGGSHESGEHSPRSNVREQDRYLPIANISRIMKKALPANGKIAKDAKETVQECVSEFISFITSEASDKCQREKRKTINGDDLLWAMATLGFEDYIDPLKIYLTRYREMEGDTKGSAKGGDSSSKKDVQPSPNAQLAHQGSFSQGVSYTISQGQHMMVPMQGPE

SEQ ID NO: 7550 - protein, 178 aa, Glycine max
  misc_feature (1)..(178): useful for making plants with modified plant phenotypes as described in USSN 12/139,269
  misc_feature (1)..(178): Public GI no. 4371295
  misc_feature (1)..(178): Utility: Useful for making plants with altered leaf shape eg curled leaves
  misc_feature (1)..(178): Utility: Useful for making smaller plants
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREGDTKGSAKGGDPNAKKDGQSSQNGQFSQLAHQGPYGNSQVTFPLFSSHSSNTHHSLLIC

SEQ ID NO: 7551 - protein, 180 aa, Zea mays
  misc_feature (1)..(180): useful for making plants with modified plant phenotypes as described in USSN 12/139,269
  misc_feature (1)..(180): Ceres CLONE ID no. 1561235
  misc_feature (1)..(180): Utility: Useful for making plants with altered leaf shape eg curled leaves
  misc_feature (1)..(180): Utility: Useful for making smaller plants
MADAPASPGGGGGSHESGSPRGGGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDIKK

SEQ ID NO: 7552 - protein, 173 aa, Zea mays
  misc_feature (1)..(173): useful for making plants with modified plant phenotypes as described in USSN 12/139,269
  misc_feature (1)..(173): Public GI no. 20147111
  misc_feature (1)..(173): Utility: Useful for making plants with altered leaf shape eg curled leaves
  misc_feature (1)..(173): Utility: Useful for making smaller plants
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREMEGDTKGSAKGGDPNAKKDGQSSQNGQFSQLAHQGPYGNSQAQQHMMVPMPGTD

SEQ ID NO: 7553 - protein, 167 aa, Zea mays
  misc_feature (1)..(167): useful for making plants with modified plant phenotypes as described in USSN 12/139,269
  misc_feature (1)..(167): Public GI no. 30409461
  misc_feature (1)..(167): Utility: Useful for making plants with altered leaf shape eg curled leaves
  misc_feature (1)..(167): Utility: Useful for making smaller plants
GRWSATRPGGGGGGGGGVREQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 7554 - protein, 174 aa, Zea mays
  misc_feature (1)..(174): useful for making plants with modified plant phenotypes as described in USSN 12/139,269
  misc_feature (1)..(174): Ceres CLONE ID no. 1559765
  misc_feature (1)..(174): Utility: Useful for making plants with altered leaf shape eg curled leaves
  misc_feature (1)..(174): Utility: Useful for making smaller plants
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGGAYNQGMGYMQPQYHNGDISN

SEQ ID NO: 7555 - protein, 164 aa, Zea mays
  misc_feature (1)..(164): useful for making plants with modified plant phenotypes as described in USSN 12/139,269
  misc_feature (1)..(164): Ceres CLONE ID no. 455104
  misc_feature (1)..(164): Utility: Useful for making plants with altered leaf shape eg curled leaves
  misc_feature (1)..(164): Utility: Useful for making smaller plants
  misc_feature (13)..(13): Xaa is any aa, unknown or other
MADDGGSHEGSGXGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 7556 - DNA, 930 bp, Arabidopsis thaliana
  misc_feature (1)..(930): useful for making plants with modified plant phenotypes as described in USSN 12/139,269
  misc_feature (1)..(930): Ceres CLONE ID no. 5055
  misc_feature (1)..(930): Also known as  Ceres CDNA ID no. 23358890
atcttttgggagaggagaaagaaaaagaaaatgggaagagggagagtagaattgaagaggatagagaacaagatcaataggcaagtgacgtttgcaaagagaaggaatggtcttttgaagaaagcatacgagctttcagttctatgtgatgcagaagttgctctcatcatcttctcaaatagaggaaagctgtacgagttttgcagtagttcgagcatgcttcggacactggagaggtaccaaaagtgtaactatggagcaccagaacccaatgtgccttcaagagaggccttagcagaacttagtagccagcaggagtatctcaagcttaaggagcgttatgacgccttacagagaacccaaaggaatctgttgggagaagatcttggacctctaagtacaaaggagcttgagtcacttgagagacagcttgattcttccttgaagcagatcagagctctcaggacacagtttatgcttgaccagctcaacgatcttcagagtaaggaacgcatgctgactgagacaaataaaactctaagactaaggttagctgatgggtatcagatgccactccagctgaaccctaaccaagaagaggttgatcactacggtcgtcatcatcatcaacaacaacaacactctcaagctttcttccagcctttggaatgtgaacccattcttcagatcgggtatcaggggcaacaagatggaatgggagcaggaccaagtgtgaataattacatgttgggttggttaccttatgacaccaactctatttgaatctttctcacttaatcaatccctctctttttttttttgacatttttaagatgatgtttctattttattacctctctcatgttttctgtcttgtgtgcatgtgtgtgtgtaatgtttatgcccttctattattcaataattttttcg

SEQ ID NO: 7557 - protein, 250 aa, Arabidopsis thaliana
  misc_feature (1)..(250): useful for making plants with modified plant phenotypes as described in USSN 12/139,269
  misc_feature (9)..(59): Pfam Name: SRF-TF; Pfam Description: SRF-type transcription factor (DNA-binding and dimerisation domain)
  misc_feature (75)..(176): Pfam Name: K-box; Pfam Description: K-box region
  misc_feature (1)..(250): Utility: Useful for making plants with altered leaf shape eg curled leaves
  misc_feature (1)..(250): Utility: Useful for making smaller plants
  misc_feature (1)..(250): Utility: Useful for making stronger plants
MGRGRVELKRIENKINRQVTFAKRRNGLLKKAYELSVLCDAEVALIIFSNRGKLYEFCSSSSMLRTLERYQKCNYGAPEPNVPSREALAELSSQQEYLKLKERYDALQRTQRNLLGEDLGPLSTKELESLERQLDSSLKQIRALRTQFMLDQLNDLQSKERMLTETNKTLRLRLADGYQMPLQLNPNQEEVDHYGRHHHQQQQHSQAFFQPLECEPILQIGYQGQQDGMGAGPSVNNYMLGWLPYDTNSI

SEQ ID NO: 7558 - protein, 254 aa, Arabidopsis thaliana
  misc_feature (1)..(254): useful for making plants with modified plant phenotypes as described in USSN 12/139,269
  misc_feature (1)..(254): Public GI no. 1617211
  misc_feature (1)..(254): Utility: Useful for making plants with altered leaf shape eg curled leaves
  misc_feature (1)..(254): Utility: Useful for making smaller plants
  misc_feature (1)..(254): Utility: Useful for making stronger plants
MGRGRVELKRIENKINRQVTFAKRRNGLLKKAYELSVLCDAEVALIIFSNRGKLYEFCSSSSMIRTLERYQKCNYGPPEPNVPSREALAVELSSQQEYLKLKERYDALQRTQRNLLGEDLGPLSTKELELLERQLDSSLKQIRALRTQFMLDQLNDLQSKERMLNETNKTLRLRLADGYQMPLQLNPNQEDHHVDYGRHDQQQQQNSHHAFFQPLECEPILQMGYQGQQDHGMEAGPSENNYMLGWLPYDTNSI

SEQ ID NO: 7559 - protein, 242 aa, Arabidopsis thaliana
  misc_feature (1)..(242): useful for making plants with modified plant phenotypes as described in USSN 12/139,269
  misc_feature (1)..(242): Public GI no. 20385588
  misc_feature (1)..(242): Utility: Useful for making plants with altered leaf shape eg curled leaves
  misc_feature (1)..(242): Utility: Useful for making smaller plants
  misc_feature (1)..(242): Utility: Useful for making stronger plants
MGRGRVELKRIENKINRQVTFAKRRNGLLKKAYELSVLCDAEVALIIFSNRGKLYEFCSSSSMLKTLERYQKCNYGAPETNVSTREALELSSQQEYLKLKARYEALQLSQRNLLGEDLGPLSTKELESLERQLDVSLKQIRSTRTQYMLDQLTDLQRKEHMLNEANKTLKQRLLEGTQVNQLQWNPNAQDVGYGRQQAQPQGDGFFHPLECEPTLQIGYQPDPITVAAAGPSVNNYMPGWLP

SEQ ID NO: 7560 - protein, 242 aa, Glycine max
  misc_feature (1)..(242): useful for making plants with modified plant phenotypes as described in USSN 12/139,269
  misc_feature (1)..(242): Ceres CLONE ID no. 511680
  misc_feature (1)..(242): Utility: Useful for making plants with altered leaf shape eg curled leaves
  misc_feature (1)..(242): Utility: Useful for making smaller plants
  misc_feature (1)..(242): Utility: Useful for making stronger plants
MGRGRVELKRIENKINRQVTFAKRRNGLLKKAYELSVLCDAEVALIIFSNRGKLYEFCSSSSMLKTLERYQKCNYGAPEANVSTREALELISQQEYLKLKARYEALQRSQRNLMGEDLGPLSSKELESLERQLDSSLKQIRSTRTQFMLDQLSDLQRKEHLLSEANRSLRQRQLEGYQINPLQLNPGVEEMGYGRHPAQTHGEALFQQMECEPTLQIGYQPDPVSVVTAGPSMSNYMAGWLP

SEQ ID NO: 7561 - protein, 253 aa, Glycine max
  misc_feature (1)..(253): useful for making plants with modified plant phenotypes as described in USSN 12/139,269
  misc_feature (1)..(253): Ceres CLONE ID no. 467502
  misc_feature (1)..(253): Utility: Useful for making plants with altered leaf shape eg curled leaves
  misc_feature (1)..(253): Utility: Useful for making smaller plants
  misc_feature (1)..(253): Utility: Useful for making stronger plants
MGRGRVELKRIENKINRQVTFAKRRNGLLKKAYELSVLCDAEVALIIFSNRGKLYEFCSSSSMLKTLERYQKCSYGAVEVSKPAKELEQSSYREYLKLKARFESLQRTQRNLLGEDLGPLNIKELEHLERQLDSSLKQVRSTKTQFMLDQLSDLQTKMLVEANRSLTVKLEEINSRNHYRQSWEAGDQSMPYGGGGPENSHSHSHSQGFFQPLECNPTLHIGPDYRYNAVASDQITATTQPQQVSGFIPGWML

SEQ ID NO: 7562 - protein, 243 aa, Zea mays
  misc_feature (1)..(243): useful for making plants with modified plant phenotypes as described in USSN 12/139,269
  misc_feature (1)..(243): Ceres CLONE ID no. 226181
  misc_feature (1)..(243): Utility: Useful for making plants with altered leaf shape eg curled leaves
  misc_feature (1)..(243): Utility: Useful for making smaller plants
  misc_feature (1)..(243): Utility: Useful for making stronger plants
MGRGRVELKRIENKINRQVTFAKRRNGLLKKAYELSVLCDAEVALIIFSNRGKLYEFCSGQSITKTLERYEKNSYGGPDTAVQNKENELVQSSRNEYLKLKARVDNLQRTQRNLLGEDLGSLGVKELEQLEKQLDSSLRHIRSTRTQHMLDQLTDLQRREQMLCEANKCLRRKLEETSNQVHGQVWEHGANLLGYERHSPQQQAPSHVGNGLFFHPLEAAAEPTLQIGFAPEHMNNFMPTWLP

SEQ ID NO: 7563 - protein, 240 aa, Zea mays
  misc_feature (1)..(240): useful for making plants with modified plant phenotypes as described in USSN 12/139,269
  misc_feature (1)..(240): Ceres CLONE ID no. 227805
  misc_feature (1)..(240): Utility: Useful for making plants with altered leaf shape eg curled leaves
  misc_feature (1)..(240): Utility: Useful for making smaller plants
  misc_feature (1)..(240): Utility: Useful for making stronger plants
  misc_feature (193)..(193): Xaa is any aa, unknown or other
MGRGRVELKRIENKINRQVTFAKRRNGLLKKAYELSVLCDAEVALIIFSNRGKLYEFSSTQSMPKTLEKYQKCSFAGPETALQNRENEQLKSSRNEYLKLKARVDNLQRTQRNLLGEDLESLGIKELEHLEKQLDSSLKHIRSTRTQHMVDQLTELQKKEQMFCEANKCLRRRLEESNQVIWQHAWEQSERHXEVQPQQLNGNNFFHPLDGAGEPTLQIGYPSEALTSSCMTTFLPPWLP

SEQ ID NO: 7564 - protein, 251 aa, Zea mays; identical to SEQ ID NO: 6951
  misc_feature (1)..(251): useful for making plants with modified plant phenotypes as described in USSN 12/139,269
  misc_feature (1)..(251): Ceres CLONE ID no. 246416
  misc_feature (1)..(251): Utility: Useful for making plants with altered leaf shape eg curled leaves
  misc_feature (1)..(251): Utility: Useful for making smaller plants
  misc_feature (1)..(251): Utility: Useful for making stronger plants

SEQ ID NO: 7565 - protein, 244 aa, Triticum aestivum; identical to SEQ ID NO: 6963
  misc_feature (1)..(244): useful for making plants with modified plant phenotypes as described in USSN 12/139,269
  misc_feature (1)..(244): Ceres CLONE ID no. 1314092
  misc_feature (1)..(244): Utility: Useful for making plants with altered leaf shape eg curled leaves
  misc_feature (1)..(244): Utility: Useful for making smaller plants
  misc_feature (1)..(244): Utility: Useful for making stronger plants

SEQ ID NO: 7566 - DNA, 921 bp, Zea mays
  misc_feature (1)..(921): useful for making plants with modified plant phenotypes as described in USSN 12/139,269
  misc_feature (1)..(921): Ceres CLONE ID no. 331626
  misc_feature (1)..(921): Also known as  Ceres CDNA ID no. 23765288
gagcaacaagagagagaggacatagccgcacaaagggaaggagaccctcgccaacctcgaagctagtccaaactagtgggaggttgagtgcagggatcgatcgaggaagacgagacaagcttcttcttctgctgccgccgccgccagctctagctcaccacgagttactagccaatctgacaccgaccgtccatggcgcggggcaaggtgcaacttcggcgcgtcgagaacccggtgcaccggcaggtgacattctgcaagcgccgcgcggggctgctcaagaaggcccgggagctctccgtcctctgcgacgccagcgtcggcatcatcgtcttctccgcgcacggcaagctctacgacctcgccaccaccgggaccatggaggagctgatcgagaggtacaaggctgccagcgccggagaagcgacgaccgacggctgcggcaggcacaacaggatggaccccaaacatgaaaccacggtgctgcaacaggaaatcaacctgcttcagaagggactgaggtacatctacgggaacagggcgaacgagcacatgaatgttgacgaactgaacgccctagagaggtacttggagatatggatgtacaacacccgctctgcaaagatgcagataatggctcaagagatccaagcactgaaaagcaaggaaggcatgttgaaagctgccaacgagattctccaggaaaagatagtagagcagagtagtttgcttgacgtaggcatggtggtagcggaccagcagaatgggcgttttagcacagtcccactggtagaagaggtgatcagtagtaacccactgactatactgagtggctattctagctgtaggggttcagagatgggctactccttctgttgattactactagtgtgtaatacatacagtcaataatgtctgtgt

SEQ ID NO: 7567 - protein, 228 aa, Zea mays
  misc_feature (1)..(228): useful for making plants with modified plant phenotypes as described in USSN 12/139,269
  misc_feature (81)..(175): Pfam Name: K-box; Pfam Description: K-box region
  misc_feature (9)..(59): Pfam Name: SRF-TF; Pfam Description: SRF-type transcription factor (DNA-binding and dimerisation domain)
  misc_feature (1)..(228): Utility: Useful for making plants with altered leaf shape eg curled leaves
MARGKVQLRRVENPVHRQVTFCKRRAGLLKKARELSVLCDASVGIIVFSAHGKLYDLATTGTMEELIERYKAASAGEATTDGCGRHNRMDPKHETTVLQQEINLLQKGLRYIYGNRANEHMNVDELNALERYLEIWMYNTRSAKMQIMAQEIQALKSKEGMLKAANEILQEKIVEQSSLLDVGMVVADQQNGRFSTVPLVEEVISSNPLTILSGYSSCRGSEMGYSFC

SEQ ID NO: 7568 - protein, 222 aa, Zea mays
  misc_feature (1)..(222): useful for making plants with modified plant phenotypes as described in USSN 12/139,269
  misc_feature (1)..(222): Public GI no. 50940449
  misc_feature (1)..(222): Utility: Useful for making plants with altered leaf shape eg curled leaves
MARGKVQLRRIENPVHRQVTFCKRRAGLLKKARELSILCEADIGIIIFSAHGKLYDLATTGTMEELIERYKSASGEQANACGDQRMDPKQEAMVLKQEINLLQKGLRYIYGNRANEHMTVEELNALERYLEIWMYNIRSAKMQIMIQEIQALKSKEGMLKAANEILQEKIVEQNGLIDVGMMVADQQNGHFSTVPLLEEITNPLTILSGYSTCRGSEMGYSF

SEQ ID NO: 7569 - protein, 224 aa, Zea mays
  misc_feature (1)..(224): useful for making plants with modified plant phenotypes as described in USSN 12/139,269
  misc_feature (1)..(224): Public GI no. 21586457
  misc_feature (1)..(224): Utility: Useful for making plants with altered leaf shape eg curled leaves
MARGKVQLRRIENPVHRQVTFCKRRAGLLKKARELSILCEADIGIIIFSAHGKLYDLATTGTMEELIERYKSASGEQANACGDQRMDPKQEAMVLKQEINLLQKGLRYIYGNRANEHMTVEELNALERYLEIWMYNIRSAKMQIMIQEIQALKSKEGMLKAANEILQEKIVEQNGLIDVGMMVADQQNGHFSTVPLLEEITNPLTILSGYSTCRGSENGLFLLT

SEQ ID NO: 7570 - protein, 213 aa, Zea mays
  misc_feature (1)..(213): useful for making plants with modified plant phenotypes as described in USSN 12/139,269
  misc_feature (1)..(213): Public GI no. 5230654
  misc_feature (1)..(213): Utility: Useful for making plants with altered leaf shape eg curled leaves
ENSTNRQVTFCKRRAGLLKKARELSILCEADIGIIIFSAHGKLYDLATTGTMEELIERYKSASGEQANACGDQRMDPKQEAMVLKQEINLLQKGLRYIYGNRANEHMTVEELNALERYLEIWMYNIRSAKMQIMIQEIQALKSKEGMLKAANEILQEKIVEQNGLIDVGMMVADQQNGHFSTVPLLEEITNPLTILSGYSTCRGSENGLFLLT

SEQ ID NO: 7571 - protein, 201 aa, Zea mays
  misc_feature (1)..(201): useful for making plants with modified plant phenotypes as described in USSN 12/139,269
  misc_feature (1)..(201): Public GI no. 24967140
  misc_feature (1)..(201): Utility: Useful for making plants with altered leaf shape eg curled leaves
MARGKVQMKRIENPVHRQVTFCKRRAGLLKKAKELSVLCDAEVGLFIFSAHGKLYELATKGSMQGLIERYIKSTKGVEVAEEAKDTQPLDPKEEINMLKNEIDVLQKGLSYMYGGGAGTMTLDELHSLEKYLEIWMYHIRSAKMDIMFQEIQLLKNKGGILEAANKYLQDKIDEQYTVTNMTQNLTDFQCPLTVQNEIFQF

SEQ ID NO: 7572 - protein, 204 aa, Zea mays
  misc_feature (1)..(204): useful for making plants with modified plant phenotypes as described in USSN 12/139,269
  misc_feature (1)..(204): Public GI no. 16549066
  misc_feature (1)..(204): Utility: Useful for making plants with altered leaf shape eg curled leaves
  misc_feature (34)..(34): Xaa is any aa, unknown or other
  misc_feature (35)..(35): Xaa is any aa, unknown or other
  misc_feature (85)..(85): Xaa is any aa, unknown or other
  misc_feature (86)..(86): Xaa is any aa, unknown or other
MARGKIQMKRIENSVHRQVTFCKRRAGLLKKARXXSVLCDVDIGLMIFSTHGKLYELATKGTMEGLIERYLGTSRGAQIEGGPAXXPPESDQEVFMLKQEIELLQKGLRNSIGGGMGNMTMDELHALERHLELWIYHIRSTKMRIMIQEIQSLKDNEGILKSANEFLQGKIEEQNVIFDMPPMIGGIPYPLTIPNEIFLEELNY

SEQ ID NO: 7573 - protein, 244 aa, Triticum aestivum; identical to SEQ ID NO: 6963
  misc_feature (1)..(244): useful for making plants with modified plant phenotypes as described in USSN 12/139,269
  misc_feature (1)..(244): Ceres CLONE ID no. 1314092
  misc_feature (1)..(244): Utility: Useful for making plants with altered leaf shape eg curled leaves

SEQ ID NO: 7574 - protein, 245 aa, Triticum aestivum
  misc_feature (1)..(245): useful for making plants with modified plant phenotypes as described in USSN 12/139,269
  misc_feature (1)..(245): Public GI no. 4204232
  misc_feature (1)..(245): Utility: Useful for making plants with altered leaf shape eg curled leaves
MGRGKVQLKRIENKINRQVTFSKRRSGLLKKAHEISVLCDAEVGLIIFSTKGKLYEFATDSCMDKILERYERYSYAEKVLISTESEIQGNWCHEYRKLKAKVETIQRCQKHLMGEDLESLNLKELQQLEQQLESSLKHIRSRKSQLMHESISELQKKERSLQEENKILQKELIEKQKAHTQQAQLEQTQPQTSSSSSSFMMGEATPATNRSNPPAAASDRAEDATGQPPARTVLPPWMVSHLNNG

SEQ ID NO: 7575 - protein, 244 aa, Triticum aestivum
  misc_feature (1)..(244): useful for making plants with modified plant phenotypes as described in USSN 12/139,269
  misc_feature (1)..(244): Public GI no. 39843112
  misc_feature (1)..(244): Utility: Useful for making plants with altered leaf shape eg curled leaves
MGRGKVQLKRIENKINRQVTFSKRRSGLLKKAHEISVLCDAEVGLIIFSTKGKLYEYATDSCMDKILERYERYSYAEKVLISAESETQGNWCHEYRKLKAKVETIQKCQKHLMGEDPESLNLKELQQLEQQLESSVKHIRSRKSQLMLESISELQKKEKSLQEENKVLQKELVEKQQVHKRLVQWDQTQPQTSSSSSSFMMREALPTTNISIYAAAAGERAEDAAGQPQIHIGLPPWMVSHING

SEQ ID NO: 7576 - protein, 244 aa, Triticum aestivum; identical to SEQ ID NO: 6964
  misc_feature (1)..(244): useful for making plants with modified plant phenotypes as described in USSN 12/139,269
  misc_feature (1)..(244): Public GI no. 39843110
  misc_feature (1)..(244): Utility: Useful for making plants with altered leaf shape eg curled leaves

SEQ ID NO: 7577 - protein, 250 aa, Triticum aestivum; identical to SEQ ID NO: 6956
  misc_feature (1)..(250): useful for making plants with modified plant phenotypes as described in USSN 12/139,269
  misc_feature (1)..(250): Public GI no. 33309864
  misc_feature (1)..(250): Utility: Useful for making plants with altered leaf shape eg curled leaves

SEQ ID NO: 7578 - protein, 246 aa, Triticum aestivum
  misc_feature (1)..(246): useful for making plants with modified plant phenotypes as described in USSN 12/139,269
  misc_feature (1)..(246): Public GI no. 7592642
  misc_feature (1)..(246): Utility: Useful for making plants with altered leaf shape eg curled leaves
MGRGKVQLKRIENKINRQVTFSKRRSGLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQLQWDQTQPQTISSSSSFMMREALPTTNISNYPAAAGERIEDVPAGQPQHVRIGLPPWMLSHING

SEQ ID NO: 7579 - protein, 246 aa, Triticum aestivum
  misc_feature (1)..(246): useful for making plants with modified plant phenotypes as described in USSN 12/139,269
  misc_feature (1)..(246): Public GI no. 6606070
  misc_feature (1)..(246): Utility: Useful for making plants with altered leaf shape eg curled leaves
MGRGKVQLKRIENKINRQVTFSKRRSKLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQVQWDQTQPQTSSSSSSFMMREALPTTNISNYPAAAGERIEDVAAGQPQHERIGLPPWMLSHING

SEQ ID NO: 7580 - DNA, 1755 bp, Arabidopsis thaliana
  misc_feature (1)..(1755): useful for making plants with modified plant phenotypes as described in USSN 12/139,269
  misc_feature (1)..(1755): Ceres CLONE ID no. 35742
  misc_feature (1)..(1755): Also known as  Ceres CDNA ID no. 23449074
cgaagaaaagcgacgccgttttaaaggagatggataaacaaccggcgaccagttggagtatccatacccggccggagataatcgccaagtacgagatcttcgagcgagtcggatccggagcttacgccgacgtttacagagctcgccgtctctccgacggtctaatcgtcgcgctcaaggagattttcgattaccaatctgcgttccgggagattgacgcgctcaccatcctcaatggatctcctaatgtagttgttatgcacgaatacttctggcgtgaggaagagaacgctgtgcttgtgcttgagtttcttaggtcggatctcgctgcggtgatccgagatggtaagaggaagaagaaggtagaaggaggggatggattctcggttggggagattaagagatggatgattcagattttaaccggtgttgatgcttgtcatcggaatttgattgtacatagagatttgaagcctgggaatatgttgatttctgatgatggagttcttaagcttgctgattttggtcaggctaggatactcatggagcatgatattgtagcttcagatgaaaaccaacaagcttacaaactggaagacaaagatggagaaaccagcgaaccaccagaagttattcctgattatgagaactcacctaggcaagggtctgatggtcaggaacgggaagcgatgagtaaagacgagtacttccgacaggtggaagagctcaaggctaaacaggttgttagagatgatactgataaggactcgaatgtgcatgatggagacatatcttgccttgcaacgtgcactgttagtgaaatggatgatgatctcggtaggaactcgttttcttacgatgctgacgaagcagtggatgatacacagggtttgatgacatcttgtgtgggaacccgatggtttaggccaccagaactgctctatggatctacgatgtatgggttagaggtcgatctatggtcgcttggttgtgtgtttgcagaactcttgtctcttgagcctttgttcccaggaatttcagatattgatcagatcagcagagtgaccaatgtgctgggaaatttaaatgaagaggtctggcctggttgtgttgatcttccagactacaagtcaatctcatttgctaaagtagaatctcctcttggtattgaaggatgccttcccaaccattcaggggatgtgatatcgctgctcaagaagcttatctgttatgatccagctagtagagctactactatggagatgctgaatgacaaatatttaagtgaagagcctcttccagttccagtttcagagctctatgtgcctccgacaatgagtggaccagatgaggattctccgagaaagtggaatgattacagagaaatggattcagattcagattttgatggctttggacccatgaatgtaaagcctaccagtagtggatttacaatagaattcccctgaccttggcatttaaggtacgcagtcaaaagctctggctcgcttaaacacataaatcagtctcttctctctctctctttcttcttcaaagagaatgggtatataccaaaacctgacatgtgtttctttaggtcttgattgatgcaacactctttgttgtttgaagatcttgttacagaataccgcttagaaaattgttaacttttcgttaggacattgtttaggtatcaatggcggcaaaaacttttgaaattcgtttgctcattgatctcacaacttttttttgcgc

SEQ ID NO: 7581 - protein, 479 aa, Arabidopsis thaliana
  misc_feature (1)..(479): useful for making plants with modified plant phenotypes as described in USSN 12/139,269
  misc_feature (21)..(418): Pfam Name: Pkinase; Pfam Description: Protein kinase domain
  misc_feature (21)..(413): Pfam Name: Pkinase_Tyr; Pfam Description: Protein tyrosine kinase
  misc_feature (1)..(479): Utility: Useful for making plants with enhanced abiotic stress tolerance
  misc_feature (1)..(479): Utility: Useful for making smaller plants
MDKQPATSWSIHTRPEIIAKYEIFERVGSGAYADVYRARRLSDGLIVALKEIFDYQSAFREIDALTILNGSPNVVVMHEYFWREEENAVLVLEFLRSDLAAVIRDGKRKKKVEGGDGFSVGEIKRWMIQILTGVDACHRNLIVHRDLKPGNMLISDDGVLKLADFGQARILMEHDIVASDENQQAYKLEDKDGETSEPPEVIPDYENSPRQGSDGQEREAMSKDEYFRQVEELKAKQVVRDDTDKDSNVHDGDISCLATCTVSEMDDDLGRNSFSYDADEAVDDTQGLMTSCVGTRWFRPPELLYGSTMYGLEVDLWSLGCVFAELLSLEPLFPGISDIDQISRVTNVLGNLNEEVWPGCVDLPDYKSISFAKVESPLGIEGCLPNHSGDVISLLKKLICYDPASRATTMEMLNDKYLSEEPLPVPVSELYVPPTMSGPDEDSPRKWNDYREMDSDSDFDGFGPMNVKPTSSGFTIEFP

SEQ ID NO: 7582 - protein, 480 aa, Arabidopsis thaliana
  misc_feature (1)..(480): useful for making plants with modified plant phenotypes as described in USSN 12/139,269
  misc_feature (1)..(480): Public GI no. 6984233
  misc_feature (1)..(480): Utility: Useful for making plants with enhanced abiotic stress tolerance
  misc_feature (1)..(480): Utility: Useful for making smaller plants
MEQLPPSPPPHAKSWSIHTRPEIIAKYEIQERVGSGAYSDVYKARRLSDNLIVALKEIHDYQSAFREIEALHIVQNCPNIVVLHEYFWREDEDAVLVLEFLRTDLASLIKEGKKNGGIGVNAGEIKRWMMQILSGLDACHRNMVVHRDLKPSNLLISDDGVLKLADFGQARILMEPGFVATATDETMHPDEQNLAVNEQKVVTSPENIPQVNPVPIEVQSNQEQVIVKGYESFRETGESKPYDYLDETSIRDGDTSCLATGTASDMGDDFMRSTYNYETDEVDNERYGSLTSCVGTRWFRAPELLYGSTDYGLEIDLWSLGCIFAELLTLEPLFPGTSDIDQLSRIINVLGNLTEQVWPGCLKLPDYGTISFNKVENPTGIESYLTNHSPEEIALVKKLVCYDPAARATAMELLRDEYFSKEPFPVPKFELGGPLLNSGQDEDFPGRYDDYFERDFDSDFDNFAPVKIRSTRTGFSKQFS

SEQ ID NO: 7583 - protein, 481 aa, Zea mays
  misc_feature (1)..(481): useful for making plants with modified plant phenotypes as described in USSN 12/139,269
  misc_feature (1)..(481): Ceres CLONE ID no. 298125
  misc_feature (1)..(481): Utility: Useful for making plants with enhanced abiotic stress tolerance
  misc_feature (1)..(481): Utility: Useful for making smaller plants
MAIVGGGGSWSIHGRADVTSRYEVLGRAGSGSYADVYRGRRRSDGAAVALKEVHDAVSARSEVEALLAIPPSPNVVALIDHFPGGDCDDDVLVLEWLPLDLAAVVRDARRRAGGGEGGEGIPASQLKRWMLQVLEGVAACHRAGVVHRDLKPENLLISEDGVLKVADFGQARILQQSAPTFQEMYPHEQSSGMETWVPQQQPAVLQGTEEEPTSYESDATAGQEPETLTAADYLRELDQLREKSSDVDKMSFQDEHASCLATCSTGDIEDDPYPASYSDDMEGIGEDSGAFTSCVGTRWFRAPELLYGSTNYGLEIDLWSLGCILAELMKLEALFPGISDIDQISRIINVLGDITEETFPGCSNLPDYNKISFNKVEKPTGLEACLPNRSPTEVSIIKQLICYDTAKRTSAVDLLNDRYFTEEPLPAPIEGLHVPASKDEDDDSSTEEWGNYRDGVSRVDFDEFGSMDATKTEKGFSIQFS

SEQ ID NO: 7584 - protein, 479 aa, Zea mays
  misc_feature (1)..(479): useful for making plants with modified plant phenotypes as described in USSN 12/139,269
  misc_feature (1)..(479): Public GI no. 54291188
  misc_feature (1)..(479): Utility: Useful for making plants with enhanced abiotic stress tolerance
  misc_feature (1)..(479): Utility: Useful for making smaller plants
MAIGGGGGGGSWSIHGRPDVTSRYEVLGRAGSGAYADVYRGRRRSDGAPVALKEVHDAVSARREADALLAAAPSRHVVALLDHFPGGDHDDDVLVLEWLPLDLSAVVRAAAAARPSALPAAQRKRWMLQVLEGVAACHSAGVVHRDLKPANLLISEDGVLKVADLGQARILQETGTYQGMHPYEQSSGVEPWVSQQRAVLHGVKENHPSHDSETQTGQEPERLTAADYLHEMDQLRAKSTHGDVDKMSLQDGNASCLATCSTADIDDDPFRASYSYDAEEGMLEEESGAFTSCVGTRWFRAPELLYGSTNYGQEVDLWSLGCILAELFNLEPIFPGTSDIDQIGRIISVLGNITEETFPGCSNLPDYNKIFFNKVEKPIGLEACLPDRSASEVSIIKRLLCYDPTKRASAADLLNDPYFAEEPLPVPIEGLQVPESKDEDDDSTEEWANFRGGDSDSDFDEFGSMDVTKTDKGFSIRFS

SEQ ID NO: 7585 - DNA, 661 bp, Arabidopsis thaliana
  misc_feature (1)..(661): useful for making plants with modified plant phenotypes as described in USSN 12/139,269
  misc_feature (1)..(661): Ceres CLONE ID no. 22382
  misc_feature (1)..(661): Also known as  Ceres CDNA ID no. 23373746
  misc_feature (632)..(632): m is a or c
  misc_feature (633)..(633): s is g or c
aaaaattctctttctcactctctcactctctttctctcttccttcatatatgctttaagtttgagcgacgtttcttctcaaagatgggtttctccgacgctggaatttacctctccgacccaaacaatctctgccaaaccgaactaggtttctttcatgaaccatctctagggttttcagaccagagcgatccacaaaacgagttccacatcactcctcctatatatcaagaattacaagatcaggatcttgaacctaaatcccaagagacgaataattgctcacgcaaagaaggagcaaccgtcaagaaagaagaagaagaagaagacgattattgtaaaactccgactcgttcagaccagattctctcggcgatgccaagaatttgtccaccggcgcctaggaaacctaaaagagtcccgtcgagaagccttaaggttagaaattcatatagaagcaagagaatgatcattctaaatgtttctagagagattgattgtttgtttaatccaacatcactatgtaacaaaattaagaaagccagatacatctaatgttttgtacgtactgtatttgtataacgtagcaacctaataaccaaattgtaatacactacgactttacataatgtmstgagaaactatctatttcacttttattt

SEQ ID NO: 7586 - protein, 156 aa, Arabidopsis thaliana
  misc_feature (1)..(156): useful for making plants with modified plant phenotypes as described in USSN 12/139,269
  misc_feature (1)..(156): Utility: Useful for making plants with increased biomass and foliage
MGFSDAGIYLSDPNNLCQTELGFFHEPSLGFSDQSDPQNEFHITPPIYQELQDQDLEPKSQETNNCSRKEGATVKKEEEEEDDYCKTPTRSDQILSAMPRICPPAPRKPKRVPSRSLKVRNSYRSKRMIILNVSREIDCLFNPTSLCNKIKKARYI

SEQ ID NO: 7587 - protein, 133 aa, Brassica napus
  misc_feature (1)..(133): useful for making plants with modified plant phenotypes as described in USSN 12/139,269
  misc_feature (1)..(133): Ceres CLONE ID no. 1094248
  misc_feature (1)..(133): Utility: Useful for making plants with increased biomass and foliage
MGFSDAGICHSDQNNLGQTEIGLLRVPSIGFSDRSVQVFRPDQDLETKVRELTNCSPEGVKNEEEEELCKTPTRLDQILPNIPNICPPAPRKPKGIQSRSLKVRDSYKSRRMIILNVSREIDCMFHSASLGNK

SEQ ID NO: 7588 - DNA, 674 bp, Arabidopsis thaliana
  misc_feature (1)..(674): useful for making plants with modified plant phenotypes as described in USSN 12/139,269
  misc_feature (1)..(674): Ceres CLONE ID no. 119790
  misc_feature (1)..(674): Also known as  Ceres CDNA ID no. 23447644
  misc_feature (499)..(499): n is a, c, t, g, unknown, or other
  misc_feature (560)..(560): n is a, c, t, g, unknown, or other
  misc_feature (573)..(573): n is a, c, t, g, unknown, or other
  misc_feature (614)..(614): n is a, c, t, g, unknown, or other
  misc_feature (629)..(629): n is a, c, t, g, unknown, or other
  misc_feature (633)..(633): n is a, c, t, g, unknown, or other
aacataaattaagtttttttttgtccttttctgcctttacctttccttctactcccgaaaaagcactgactttgctctgtttccttcgttcacacagagaaagagagaaatcttctgagcgaaattctgacaaaagagatgatggaatgggataatcagctacaacccaataaccatcactcttctaatcttcaagggatcgacgttaatggcggctccggcgccggaggaggaatgtacgtgaaggtgatgaccgatgagcagtatgaaactctcaggaaacagattgctatttacggcaccatttgtgagcgtcttgttgagatgcataaaactctcactgctcaacaagatcttgcaggagggagaatgggaggactatatgcagaccccaatgatgtcatctttaggtcataagatgacagctagacagaggtggactcctacgccagtccagcttcagattctggaacgtatattcgatcaaggcacgggaacncccgagcaagcagaagatcaaagacataacagaagagcttgagcccacacgggcagattgnttgaacaaaatgnctataactgggttccagaacccgacgtgctcgatccaaganggaagcagcatgggngganggtctttcttggaaaaaaaataaatggggaagtctgaggta

SEQ ID NO: 7589 - protein, 133 aa, Arabidopsis thaliana
  misc_feature (1)..(133): useful for making plants with modified plant phenotypes as described in USSN 12/139,269
  misc_feature (1)..(133): Utility: Useful for making plants with increased biomass and foliage
  misc_feature (120)..(120): Xaa is any aa, unknown or other
MMEWDNQLQPNNHHSSNLQGIDVNGGSGAGGGMYVKVMTDEQYETLRKQIAIYGTICERLVEMHKTLTAQQDLAGGRMGGLYADPMMSSLGHKMTARQRWTPTPVQLQILERIFDQGTGXPEQAEDQRHNRRA

SEQ ID NO: 7590 - protein, 268 aa, Arabidopsis thaliana
  misc_feature (1)..(268): useful for making plants with modified plant phenotypes as described in USSN 12/139,269
  misc_feature (1)..(268): Ceres CLONE ID no. 1350005
  misc_feature (1)..(268): Utility: Useful for making plants with increased biomass and foliage
MMEWDNQLQPNNHHSSNLQGIDVNGGSGAGGGMYVKVMTDEQYETLRKQIAIYGTICERLVEMHKTLTAQQDLAGGRMGGLYADPMMSSLGHKMTARQRWTPTPVQLQILERIFDQGTGTPSKQKIKDITEELSQHGQIAEQNVYNWFQNRRARSKRKQHGGGSSGNNNGESEVETEVEALNEKRVVRPESLLGLPDGNSNNNGLGTTTATTTAPRPEDLCFQSPEISSDLHLLDVLSNPRDEHLVGKMGLAESYNLYDHVEDYGMSG

SEQ ID NO: 7591 - protein, 268 aa, Arabidopsis thaliana; identical to SEQ ID NO: 7590
  misc_feature (1)..(268): useful for making plants with modified plant phenotypes as described in USSN 12/139,269
  misc_feature (1)..(268): Public GI no. 23308275
  misc_feature (1)..(268): Utility: Useful for making plants with increased biomass and foliage

SEQ ID NO: 7592 - protein, 292 aa, Zea mays
  misc_feature (1)..(292): useful for making plants with modified plant phenotypes as described in USSN 12/139,269
  misc_feature (1)..(292): Ceres CLONE ID no. 1379507
  misc_feature (1)..(292): Utility: Useful for making plants with increased biomass and foliage
FPSRALRPSSVSFIHTERETQKTKTLRKEMMEWDNQQQPSNNPSSNLQGIDVNGGSGSGGMYVKVMTDEQLETLRKQIAIYATICERLVEMHKTLTSQQDLAGRVGGLYADPTFGHKMTGGRQRWTPTPVQLQILERIFDQGIGTPSKQKIKDITEELSQHGQIAEQNVYNWFQNRRARSKRKQHGGGGGGVGSSSNNNNGESEVEAETETVNEKRKMPESLLVFPDGNKNAIGTTSATSPRPEDLYFQSPEMSSDLDLLGVLSNPRDEHFVGKMGLSESYNMYDHVEDYGM

SEQ ID NO: 7593 - protein, 261 aa, Zea mays
  misc_feature (1)..(261): useful for making plants with modified plant phenotypes as described in USSN 12/139,269
  misc_feature (1)..(261): Public GI no. 3955021
  misc_feature (1)..(261): Utility: Useful for making plants with increased biomass and foliage
KLVFYDCQSIAGRMDWDNNQENHQDSHQNQRECRNGINGTNVNVNGNGGTNMLYVKVMTDEQLETLRKQIAVYAAICEQLVEMHKTLSAQQDLAGGRLGNLYCDPLMASGGHKITARQRWTPTPVQLQILERIFDQGNGTPSKQKIKEITSELSQHGQISETNVYNWFQNRRARSKRKQLVASSNNAESEVETEVDSLNEKKKPEIFHAQQNPPRAEDLCFQSPEISSELHFLGDDHLTGKVGVPGNYNLYDQAEDYGMAG

SEQ ID NO: 7594 - protein, 257 aa, Zea mays
  misc_feature (1)..(257): useful for making plants with modified plant phenotypes as described in USSN 12/139,269
  misc_feature (1)..(257): Public GI no. 40233087
  misc_feature (1)..(257): Utility: Useful for making plants with increased biomass and foliage
CQSIAGRMDWDNNQENHQDSHQNQRECRNGINGTNVNVNVNGNGGNNTLYVKVMTDEQLETLRKQIAVYAAICEQLVEMHKTLSAQQDLAGGRLGNLYCDPLMASGGHKITARQRWTPTPVQLQILERIFDQGNGTPSKQKIKEITSELSQHGQISETNVYNWFQNRRARSKRKQLVASSNNAESEVETEVDSLNEKKKPEIFHAQQNPPRAEDLCFQGPEISSELHFLGDDHLTGKMGVPGNYNLYDQAEDYGMAG

SEQ ID NO: 7595 - protein, 262 aa, Glycine max
  misc_feature (1)..(262): useful for making plants with modified plant phenotypes as described in USSN 12/139,269
  misc_feature (1)..(262): Ceres CLONE ID no. 609489
  misc_feature (1)..(262): Utility: Useful for making plants with increased biomass and foliage
MEWQKQRWQPNGNAEMMYVKVMTDEQLETLRKQIAVYATICEQLIEMHKNISSHQDLAGIRLGNMYCDPLLGSGGHKIASRQRWTPSAMQLQILERIFDQGAGTPTKEKIKEITNELSQHGQISETNVYNWFQNRRARSKRKQQNVAPSANAESEVETEVDSKDKKTKPDEFQSPPSVSAVPADDNLGFQNHGSLQYLNPESNKPDSVFPSDASLRSTRNFNHVPVFDGLLSNSTSDYLTGKMEAPENYDLYQPAGDFNMAG

SEQ ID NO: 7596 - protein, 262 aa, Glycine max
  misc_feature (1)..(262): useful for making plants with modified plant phenotypes as described in USSN 12/139,269
  misc_feature (1)..(262): Ceres CLONE ID no. 561279
  misc_feature (1)..(262): Utility: Useful for making plants with increased biomass and foliage
MVNAMEWQKQRCWQPNRNAEMMCVKVMTDEQLEILRKQIAVYATICEQLIEMHKNISAHQDLAGIRLGNMYCDPLLGSGGLKIASRQRWTPTAMQLQILERIFDQGIGTPTKEKIKEITNELSQHGQISETNVYNWFQNRRARSKRKQQNVAPSANAESEVETEVDSKDKKTKPDEFQAPPSVSAGPADNLGFQNHDSLQYLNPESNKPDSVFPSDGTRNFHHVPAFDGLLSNSRSNYLTGKLETPENYELYQPAGDYNIAG

SEQ ID NO: 7597 - protein, 250 aa, Glycine max
  misc_feature (1)..(250): useful for making plants with modified plant phenotypes as described in USSN 12/139,269
  misc_feature (1)..(250): Public GI no. 34909272
  misc_feature (1)..(250): Utility: Useful for making plants with increased biomass and foliage
MEWDKAKASSGEAVDDRGGGEGGLGYVKVMTDEQMEVLRKQISIYATICEQLVEMHRALTAQQDSIAGMRLGNLYCDPLMVPGGHKITARQRWTPTPMQLQILENIFDQGNGTPSKQKIKDITAELSQHGQISETNVYNWFQNRRARSKRKQAALPNNNAESEAEADEESPTDKKPKSDRPLHQNIAMRDHNSERISEMHHFDTEHEQIRRMMYASNDSSSRSSGSLGQMSFYDNVMSNPSTSYKHPCFI

SEQ ID NO: 7598 - protein, 267 aa, Glycine max
  misc_feature (1)..(267): useful for making plants with modified plant phenotypes as described in USSN 12/139,269
  misc_feature (1)..(267): Public GI no. 56201899
  misc_feature (1)..(267): Utility: Useful for making plants with increased biomass and foliage
MEWDKAKASSGEAVDDRGGGEGGLGYVKVMTDEQMEVLRKQISIYATICEQLVEMHRALTAQQDSIAGMRLGNLYCDPLMVPGGHKITARQRWTPTPMQLQILENIFDQGNGTPSKQKIKDITAELSQHGQISETNVYNWFQNRRARSKRKQAALPNNNAESEAEADEESPTDKKPKSDRPLHQNIAMRDHNSERISEMHHFDTEHEQIRRMMYASNDSSSRSSGSLGQMSFYDNVMSNPRIDHFLGKVESPGSFPHMRSGESFDMY

SEQ ID NO: 7599 - DNA, 994 bp, Arabidopsis thaliana
  misc_feature (1)..(994): useful for making plants with modified plant phenotypes as described in USSN 12/139,269
  misc_feature (1)..(994): Ceres CLONE ID no. 34976
  misc_feature (1)..(994): Also known as  Ceres CDNA ID no. 23374632
atcgaaaatcagattttctctgcaaactctcagattcacctttcaagaaaaaaacagagagagagagagaacaaagaaggatgacgaaaattgactctctccgtcgatttcttcttccatgtatctcaactccgacgaatccaaccaccgtatcaacaacatccaccggagcttccaagaaacgtctcagtacttccctaagagacgatatcgacgttcaagattcagcttcttcctccgcctcttcctccgaggctacttccgccgtcgactacagcatatccgccgtcacggtgccgcagagaccgtcgaagacgatggtgattggtacgatattcggtagaagaaagggacacgtgtggttctgtgttcaacacgaccgtctctctgttaaaccaatccttctcctcgagctttcaatagctacgagccagttagttcacgagatgggttcgggtcttgttcgtgtcgctttagaatgcccgacccgacccgaattgaagtcttgcttgctgagatccgtacccgtttggacgatgttttgtaacggaaggaagctagggtttgctgtacggagaagtgctaatgaagagacgaggatgatgttgaagagattggagtctatgactgttggagcgggtgtgttgccatctggatccgggttgggtgggtctgatgaatcggatactgatgaggttatgtatatgagagcgaattatgagcatgttgttggtagctctgactcggagtcgtttcatctcattaaccctgatgctaactctgctcaagaactcagtatcttcttgctcaggacctctagttgaattggccttttggggtaacttatgaatcattttcatcatgttcagagattgtgaagtcacatgagaaagattgagattttgagagttcttgatgagatatttctttgtgggtcgttagttctagatctttgtaaaacattattttgttagaaagattgatgatttttttc

SEQ ID NO: 7600 - protein, 247 aa, Arabidopsis thaliana
  misc_feature (1)..(247): useful for making plants with modified plant phenotypes as described in USSN 12/139,269
  misc_feature (80)..(245): Pfam Name: DUF617; Pfam Description: Protein of unknown function, DUF617
  misc_feature (80)..(245): Pfam Name: DUF617; Pfam Description: Protein of unknown function, DUF617
  misc_feature (1)..(247): Utility: Useful for making plants with increased biomass and foliage
  misc_feature (1)..(247): Utility: Useful for making smaller plants
MTKIDSLRRFLLPCISTPTNPTTVSTTSTGASKKRLSTSLRDDIDVQDSASSSASSSEATSAVDYSISAVTVPQRPSKTMVIGTIFGRRKGHVWFCVQHDRLSVKPILLLELSIATSQLVHEMGSGLVRVALECPTRPELKSCLLRSVPVWTMFCNGRKLGFAVRRSANEETRMMLKRLESMTVGAGVLPSGSGLGGSDESDTDEVMYMRANYEHVVGSSDSESFHLINPDANSAQELSIFLLRTSS

SEQ ID NO: 7601 - DNA, 1649 bp, Arabidopsis thaliana; identical to SEQ ID NO: 4011
  misc_feature (1)..(1649): useful for making plants with modified plant phenotypes as described in USSN 12/139,269
  misc_feature (1)..(1649): Ceres CLONE ID no. 36334
  misc_feature (1)..(1649): Also known as  Ceres CDNA ID no. 23374338

SEQ ID NO: 7602 - protein, 472 aa, Arabidopsis thaliana; identical to SEQ ID NO: 4010
  misc_feature (1)..(472): useful for making plants with modified plant phenotypes as described in USSN 12/139,269
  misc_feature (205)..(467): Pfam Name: p450; Pfam Description: Cytochrome P450
  misc_feature (1)..(472): Utility: Useful for making plants with increased biomass and foliage
  misc_feature (1)..(472): Utility: Useful for making smaller plants

SEQ ID NO: 7603 - protein, 479 aa, Glycine max; identical to SEQ ID NO: 4014
  misc_feature (1)..(479): useful for making plants with modified plant phenotypes as described in USSN 12/139,269
  misc_feature (1)..(479): Ceres CLONE ID no. 690176
  misc_feature (1)..(479): Utility: Useful for making plants with increased biomass and foliage
  misc_feature (1)..(479): Utility: Useful for making smaller plants

SEQ ID NO: 7604 - protein, 472 aa, Glycine max; identical to SEQ ID NO: 4020
  misc_feature (1)..(472): useful for making plants with modified plant phenotypes as described in USSN 12/139,269
  misc_feature (1)..(472): Ceres CLONE ID no. 574698
  misc_feature (1)..(472): Utility: Useful for making plants with increased biomass and foliage
  misc_feature (1)..(472): Utility: Useful for making smaller plants

SEQ ID NO: 7605 - protein, 485 aa, Zea mays; identical to SEQ ID NO: 3824
  misc_feature (1)..(485): useful for making plants with modified plant phenotypes as described in USSN 12/139,269
  misc_feature (1)..(485): Ceres CLONE ID no. 234510
  misc_feature (1)..(485): Utility: Useful for making plants with increased biomass and foliage
  misc_feature (1)..(485): Utility: Useful for making smaller plants

SEQ ID NO: 7606 - protein, 480 aa, Zea mays
  misc_feature (1)..(480): useful for making plants with modified plant phenotypes as described in USSN 12/139,269
  misc_feature (1)..(480): Ceres CLONE ID no. 390429
  misc_feature (1)..(480): Utility: Useful for making plants with increased biomass and foliage
  misc_feature (1)..(480): Utility: Useful for making smaller plants
MMMMAGEHVLAALATLLLASLLTLVLNHFLPLLLNPKAPRGSFGWPLLGETLRFLTPHASNTLGGFLEDHCSRYGRVFKSHLFCTPTVVSCDQDLNHFILQNEERLFQCSYPRPIHGILGKSSMLVVLGEDHKRLRNLALALVTSTKLKPSYLGDIEKIALHVVGAWRRHGGVRVVAFCEEARKFAFSVIVKQVLGLSPEEPVTARILEDFLAFMKGLISFPLYIPGTPYAKAVRARERISSTVKGIIKERRSAGSWNKQGDFLDVLLSSNELSDEEKVSFVLDSLLGGYETTSLLISMVVYFLGQSAQDLDLVKREHDSIRSNKGKEECLTSEDYKKMEYTQQVINEALRCGNIVKFVHRKALKDVKYKEYLIPSGWKVLPVFTAVHLNPSLHGDAQQFQPCRWEGTSQGTSKRFTPFGGGPRLCPGSELAKVETAFFLHHLVLNYRWRIDGDDIPMAYPYVEFQRGLPIEIEPTSPES

SEQ ID NO: 7607 - DNA, 960 bp, Arabidopsis thaliana
  misc_feature (1)..(960): useful for making plants with modified plant phenotypes as described in USSN 12/139,269
  misc_feature (1)..(960): Ceres CLONE ID no. 102248
  misc_feature (1)..(960): Also known as  Ceres CDNA ID no. 23363381
tctgtctgtaatggcatgcttagaaatgtacaactccaatggtggtggtggaactcccatgagtcctagaatctccttctctaacgatttcgttgagattaggccagagacgaccaagacgacgagatcaagccctctctctaaacaagagggttcttcttcttctttttcagataatttcgagttctctgtctcaaactacacaatgatgccagctgatgaacttttctctaaaggaaagcttttgcctttcaaggaaaccaatcaagtccagagaactttaagagaagagcttctcgttgaagaagacgaagaagaaggtccacgtgatgctaccaacatcttctctctcaagccaccaatcttctcatcatcttcttcttcttcttcttcttccaagggaaggtggaaagggcttttgggccttaagagggcccatgttgggtctaagaacaatgacgagcgatttgttcatcatatgattaacaacaacaaacaatctcaggaagcaattggtggaagagaagggtcaagttgcagggagatgaagaagagtatgtagagcttaaaaacaaaaaaggctttcacttggtttttgtttttttaggaacatggctgcttccaaatttttaaaaatttagatttatgttaatcttagatctgaaaaattactaaaaaaaaagacacttatgtgttgttgacggagatggtttatttcattaactgttttccactacacatgtttcatcgattcttctgagtttttatcttgttttttctttttcttttgaagggtgtgagtattagatctatctttgtcgactatttggaatgaatgtagtttttttttttgtcgttgtacaaaagaaaaaaagaagaacagagtgtgagtagttcagaaaatttaagttccagttgttttttaaaattgaagcaacgcatatgtctattgtcttcgtc

SEQ ID NO: 7608 - protein, 183 aa, Arabidopsis thaliana
  misc_feature (1)..(183): useful for making plants with modified plant phenotypes as described in USSN 12/139,269
  misc_feature (1)..(183): Utility: Useful for making plants with increased biomass and foliage
  misc_feature (1)..(183): Utility: Useful for making shorter plants and plants with modified flowers
  misc_feature (1)..(183): Utility: Useful for making smaller plants
MACLEMYNSNGGGGTPMSPRISFSNDFVEIRPETTKTTRSSPLSKQEGSSSSFSDNFEFSVSNYTMMPADELFSKGKLLPFKETNQVQRTLREELLVEEDEEEGPRDATNIFSLKPPIFSSSSSSSSSSKGRWKGLLGLKRAHVGSKNNDERFVHHMINNNKQSQEAIGGREGSSCREMKKSM

SEQ ID NO: 7609 - protein, 166 aa, Arabidopsis thaliana
  misc_feature (1)..(166): useful for making plants with modified plant phenotypes as described in USSN 12/139,269
  misc_feature (1)..(166): Public GI no. 28466849
  misc_feature (1)..(166): Utility: Useful for making plants with increased biomass and foliage
  misc_feature (1)..(166): Utility: Useful for making shorter plants and plants with modified flowers
  misc_feature (1)..(166): Utility: Useful for making smaller plants
MARLEMHNSMNGAARISFSNEFVEIRSEKSNAKSNNINSRSSFSMPSADFAFSVTDYSMIPADEIFLKGKILPFKETSHVHRTLGEELLTEEEGSMVDGNTFSLRPILLSSSSFSTKGTWRELLGLKRTHVRSKKTDKVNEEVLSQDHKIISGNVATRECQVADTR

SEQ ID NO: 7610 - protein, 146 aa, Zea mays
  misc_feature (1)..(146): useful for making plants with modified plant phenotypes as described in USSN 12/139,269
  misc_feature (1)..(146): Ceres CLONE ID no. 1061902
  misc_feature (1)..(146): Utility: Useful for making plants with increased biomass and foliage
  misc_feature (1)..(146): Utility: Useful for making shorter plants and plants with modified flowers
  misc_feature (1)..(146): Utility: Useful for making smaller plants
MACVDMYNPEHHHQHQPAPPSFMAPRMSFSSDFAVEPPPPAAARGGGDADFEFSVGSHPMMAADQLFSKGRLLPLREAPQQAAGGRPVTLRDELRADERHGRAPRATNIRWKELLGLKKAPKKQQAAAAAADAAAGASTDAHMVGH

SEQ ID NO: 7611 - protein, 163 aa, Triticum aestivum
  misc_feature (1)..(163): useful for making plants with modified plant phenotypes as described in USSN 12/139,269
  misc_feature (1)..(163): Ceres CLONE ID no. 827699
  misc_feature (1)..(163): Utility: Useful for making plants with increased biomass and foliage
  misc_feature (1)..(163): Utility: Useful for making shorter plants and plants with modified flowers
  misc_feature (1)..(163): Utility: Useful for making smaller plants
MACVNMYNPDGGAVAFGGGQPGPRISFSSDFSMEPPPPVQNRAMGLRCQEEDQNFEFSVGSHPMMAADQLFSKGRILPFKVEGGRPPSTLRDELRGGAADEERASTTPKGSSRWREMLGLRKSLCVGGGVASNAAAAKKSDKVVAVDADAKIATDMAAPKQEL

SEQ ID NO: 7612 - protein, 180 aa, Glycine max
  misc_feature (1)..(180): useful for making plants with modified plant phenotypes as described in USSN 12/139,269
  misc_feature (1)..(180): Ceres CLONE ID no. 562697
  misc_feature (1)..(180): Utility: Useful for making plants with increased biomass and foliage
  misc_feature (1)..(180): Utility: Useful for making shorter plants and plants with modified flowers
  misc_feature (1)..(180): Utility: Useful for making smaller plants
  misc_feature (91)..(91): Xaa is any aa, unknown or other
MSPRISFSNDFVDLKQAMKQEQRGSSRSDAPVSSDFEFSVANYSMMSADELFFKGRLMSTYNKDNCNNNNKNNHMMMMQQQRATTTTTTTXKEELLINDDDHDHDFSLRPPKPSSTRWKGLLGLRKTHIGSKKPHKSTEGGSSDATRSALVNDSPPTSITSSQEVLNEGGSSCRDLEIGI

SEQ ID NO: 7613 - protein, 146 aa, Zea mays
  misc_feature (1)..(146): useful for making plants with modified plant phenotypes as described in USSN 12/139,269
  misc_feature (1)..(146): Ceres CLONE ID no. 218046
  misc_feature (1)..(146): Utility: Useful for making plants with increased biomass and foliage
  misc_feature (1)..(146): Utility: Useful for making shorter plants and plants with modified flowers
  misc_feature (1)..(146): Utility: Useful for making smaller plants
  misc_feature (87)..(87): Xaa is any aa, unknown or other
  misc_feature (90)..(90): Xaa is any aa, unknown or other
MYNPEQHQAAPPFMAPRMSFSSDFAVEPPPPAAARGGAAGPGDADFEFSVGSHPMMAADQLFSKGRLLPLREAPQQAGGGARPVTLXEEXRADERHGRVPRAPNIRWKELLGLKKAPKKQAAADAAAGTSADAHMDLGGQQGSTRD

SEQ ID NO: 7614 - protein, 156 aa, Triticum aestivum
  misc_feature (1)..(156): useful for making plants with modified plant phenotypes as described in USSN 12/139,269
  misc_feature (1)..(156): Ceres CLONE ID no. 758144
  misc_feature (1)..(156): Utility: Useful for making plants with increased biomass and foliage
  misc_feature (1)..(156): Utility: Useful for making shorter plants and plants with modified flowers
  misc_feature (1)..(156): Utility: Useful for making smaller plants
MYNPEHHQSSFMAPRMSFSSDFALEPPPASAPSARGPGDADFEFSVGSRPMMAADELFSKGRLLPLREAPHGQSGRPTTLREELRTDDRHGRAPRAPNIRWKELLGFKKANKKAAAAAADAGASTSSAEAAAADAGASTSSAEAHTDLGGHGGTRE

SEQ ID NO: 7615 - protein, 153 aa, Triticum aestivum
  misc_feature (1)..(153): useful for making plants with modified plant phenotypes as described in USSN 12/139,269
  misc_feature (1)..(153): Public GI no. 50913049
  misc_feature (1)..(153): Utility: Useful for making plants with increased biomass and foliage
  misc_feature (1)..(153): Utility: Useful for making shorter plants and plants with modified flowers
  misc_feature (1)..(153): Utility: Useful for making smaller plants
MACINMYNPDGGAAFGGGQPPALGPRISFSSDFVVEPPPPVQNRAMNLRCQEEDINFEFSVGSHPMMAADQLFSKGRILPLKDGGFSSGRPPTTLRDELRCDDRASAKGSSRWKEMLGLRKPLCVGGVNGTAKKSTTVDTEMVTDVADSKQEQ

SEQ ID NO: 7616 - protein, 157 aa, Triticum aestivum
  misc_feature (1)..(157): useful for making plants with modified plant phenotypes as described in USSN 12/139,269
  misc_feature (1)..(157): Public GI no. 51536211
  misc_feature (1)..(157): Utility: Useful for making plants with increased biomass and foliage
  misc_feature (1)..(157): Utility: Useful for making shorter plants and plants with modified flowers
  misc_feature (1)..(157): Utility: Useful for making smaller plants
MACVNMYNPEHHHHQSSSFMAPRISFSSDFALEPPPPAQQQPAVRAPGDADFEFSVGSHPMMAADQLISKGRLLPLREAPHGHGGADAGGRPLTLRDELRTDSRHGRVPRAPNIRWKEFLGLKKAPKKAPTADAAAGATSSSADTQMDLGGQGSTRD

SEQ ID NO: 7617 - protein, 182 aa, Zea mays
  misc_feature (1)..(182): useful for making plants with modified plant phenotypes as described in USSN 12/139,269
  misc_feature (1)..(182): Ceres CLONE ID no. 305610
  misc_feature (1)..(182): Utility: Useful for making plants with increased biomass and foliage
  misc_feature (1)..(182): Utility: Useful for making shorter plants and plants with modified flowers
  misc_feature (1)..(182): Utility: Useful for making smaller plants
MYNPDGAAGFGGGPQQPAALGPRISFSSDFAVEPTPVQNRATSLRCQEEDLNFEFSVGSHPMMAADQLFSKGRILPLKDNGGGSVCFAAARPPTTLRDELRGGGDDDDERAAFSAAGTKGSNSNRWKEMLGLRKALCVGVGGGGNGSPAKKASSSDKQGVVAAAAPGPDDHMAASNQQEQLS

SEQ ID NO: 7618 - protein, 189 aa, Zea mays
  misc_feature (1)..(189): useful for making plants with modified plant phenotypes as described in USSN 12/139,269
  misc_feature (1)..(189): Ceres CLONE ID no. 218076
  misc_feature (1)..(189): Utility: Useful for making plants with increased biomass and foliage
  misc_feature (1)..(189): Utility: Useful for making shorter plants and plants with modified flowers
  misc_feature (1)..(189): Utility: Useful for making smaller plants
  misc_feature (104)..(104): Xaa is any aa, unknown or other
MACINMYNTDGTAGFGGGPQPPAALGPRVSFSSDFAVEPPPVQNRAMSLRCQEEDVNFEFSVGSHPMMAADQLFSKGRILPLRDNGGCFAAARPPTTLRDELCXGGGVSSDDDERASAAGSKGSGRWKEMLGLRKALCVGNGPPAKKASSGKQGVADDMAASNQGLCYDRADGRDETIIGGTAPQTSHA

SEQ ID NO: 7619 - protein, 160 aa, Zea mays
  misc_feature (1)..(160): useful for making plants with modified plant phenotypes as described in USSN 12/139,269
  misc_feature (1)..(160): Public GI no. 50946783
  misc_feature (1)..(160): Utility: Useful for making plants with increased biomass and foliage
  misc_feature (1)..(160): Utility: Useful for making shorter plants and plants with modified flowers
  misc_feature (1)..(160): Utility: Useful for making smaller plants
MYNPEQQQPPLPHHQLMAPPRMSFSSDFALEPPPPPSGPGRASMGDADFEFSAVGSRPMITADQLFSKGRILPMREVSGGGGGGGRAVTLRDELRGHDGAAVADGRHRRAARPAGSGGGGGVRWKEMLGLKRPGHRKHGAADEGGASTHDLDHMDLGGGE

SEQ ID NO: 7620 - DNA, 623 bp, Arabidopsis thaliana
  misc_feature (1)..(623): useful for making plants with modified plant phenotypes as described in USSN 12/139,269
  misc_feature (1)..(623): Ceres CLONE ID no. 157709
  misc_feature (1)..(623): Also known as  Ceres CDNA ID no. 23361678
atccactcttgattcatggatgatgaaaacttgtggaaagttgtgaagaaagattccatcttcgaaacgactcatttctcttcaaaacctgttttcacacgaagcttctcaacaaaaacttcttcttcttcttcaaaacccgttttcacaagaagtttctcaactaaacccacttcgtattcttcatcagagcccatctttagacggagtttctctgcaaaacccacttcttcgaaatctccgtttctatctagaagcggttccacgaaatgccctgttgatacatcttctacttccaagtgttccatctctcggagcttgtctcagaaaggagcttcggtgacccgaaagtgtcgtaatatggccaaggaacacaagtctcggttttacatcatgaaacgttgcgttctgatgctcgtttgttggcacaaacatgcctgtgattcgtgaagaaagatgcataattaggttatttaattacagattcactctttttttcttatttttttacccatctgttaatttttttccttaagttttctgtattaatgatatactccctccatctcttaaattaaatgtatttttgttttatttatttattttacaaagtgatgttttac

SEQ ID NO: 7621 - protein, 144 aa, Arabidopsis thaliana
  misc_feature (1)..(144): useful for making plants with modified plant phenotypes as described in USSN 12/139,269
  misc_feature (118)..(136): Pfam Name: DVL; Pfam Description: DVL family
  misc_feature (1)..(144): Utility: Useful for making plants with increased biomass and foliage
MDDENLWKVVKKDSIFETTHFSSKPVFTRSFSTKTSSSSSKPVFTRSFSTKPTSYSSSEPIFRRSFSAKPTSSKSPFLSRSGSTKCPVDTSSTSKCSISRSLSQKGASVTRKCRNMAKEHKSRFYIMKRCVLMLVCWHKHACDS

SEQ ID NO: 7622 - protein, 144 aa, Arabidopsis thaliana
  misc_feature (1)..(144): useful for making plants with modified plant phenotypes as described in USSN 12/139,269
  misc_feature (1)..(144): Public GI no. 42822063
  misc_feature (1)..(144): Utility: Useful for making plants with increased biomass and foliage
MDVEKLWNHTKKDSIFQTTHFSSSSKPFFTRSFSTKTSSSPSSKSHFTRSFSTKPSSSSSSSDLIFRRSFSAKPKTSKSLLLSRSCSTKSSADLSSKSSSLSRILSKKGASVTGKCFKVAKEHKSRFYIIKRCVLMLVCWHKHS

SEQ ID NO: 7623 - DNA, 1103 bp, Arabidopsis thaliana
  misc_feature (1)..(1103): useful for making plants with modified plant phenotypes as described in USSN 12/139,269
  misc_feature (1)..(1103): Ceres CLONE ID no. 24885
  misc_feature (1)..(1103): Also known as  Ceres CDNA ID no. 23557376
  misc_feature (911)..(911): b is g or c or t/u
  misc_feature (956)..(956): k is g or t/u
accaccgaaacccactaagaatacagcaaatcgtctcttcgccattaaaacaccttcctttgcaaacaaagcttcaaactttctcttaaaacacccccaaatcagcaaagatagggttaatcgaagaacctcaccgtaagtccactgaggattcaagttcttgctttggtttaaggaagaagaacagcaaaaacctcaaggagaagaagaagtcaaagatgactcagagtcaaaccaacgacggagctggagctggagctgttacgacggtagaatctgttcctcctcagcctcaatctcagcctcagcctcagccgcagcagcagagcaacgagatggttctgcatacgggaagcttgagttttagtagtcatatgtcgagagaagacgaagagatgactcgttctgctctttcggcgtttagagctaaagaagatgagattgagaagaggaggatggaagttcgtgaacggatccaagctcaattgggtcgggtcgaacaagaaaccaaacgtctctctactattcgtgaggagcttgagtctatggcagatcctatgaggaaggaagtttctgtggttcgtaagaagattgatagtgttaacaaagaactcaaacctctaggttccactgttcaaaagaaggaaagggaatacaaagaagcacttgatacattcaacgagaagaacagggagaaagtacagctgatcacaaaactcatggagatggaacagttggttggagaaagcgagaagttgaggatgattaagctggaggagctgagcaagagcatagaaaccgtgtgaaaaaggttgttcaagaagaactaattgggttcttttgtgtgatgtacctacctagtttaaaattttcatcatgtaagatgtgtgggttgcttttttttttattgbtatagtttttttaaagtctttgggggtttgatttgtaaaatttgkgggttctctcttatttttgattaaccaaatttagggatatgggaaaatgggagattcttaggatactgaaactcatcacagtgattattctttctttctctgtattatgttttgtatctgtcttttgaagaatttattatttttttt

SEQ ID NO: 7624 - protein, 195 aa, Arabidopsis thaliana
  misc_feature (1)..(195): useful for making plants with modified plant phenotypes as described in USSN 12/139,269
  misc_feature (30)..(195): Pfam Name: DUF662; Pfam Description: Family of unknown function (DUF662)
  misc_feature (1)..(195): Utility: Useful for making plants with increased biomass and foliage
  misc_feature (1)..(195): Utility: Useful for making smaller plants
MTQSQTNDGAGAGAVTTVESVPPQPQSQPQPQPQQQSNEMVLHTGSLSFSSHMSREDEEMTRSALSAFRAKEDEIEKRRMEVRERIQAQLGRVEQETKRLSTIREELESMADPMRKEVSVVRKKIDSVNKELKPLGSTVQKKEREYKEALDTFNEKNREKVQLITKLMEMEQLVGESEKLRMIKLEELSKSIETV

SEQ ID NO: 7625 - protein, 176 aa, Glycine max
  misc_feature (1)..(176): useful for making plants with modified plant phenotypes as described in USSN 12/139,269
  misc_feature (1)..(176): Ceres CLONE ID no. 693935
  misc_feature (1)..(176): Utility: Useful for making plants with increased biomass and foliage
  misc_feature (1)..(176): Utility: Useful for making smaller plants
MATPKQSYEQQQQQQQPNVQRVRNSGMINSNQSPMRDDKEEEMSRSALAMFRAKEEEIERRKVEVRDKVHAYLGRVEEETKRLAEIREELEGLTDPLRKEVAIVRKKIDSVNKELKPLGQTCQRKEREYKEALDAFNEKNKEKAQLVTKLMELVTESEKLRMKKLEELSKNVDTLH

SEQ ID NO: 7626 - protein, 157 aa, Zea mays
  misc_feature (1)..(157): useful for making plants with modified plant phenotypes as described in USSN 12/139,269
  misc_feature (1)..(157): Ceres CLONE ID no. 359934
  misc_feature (1)..(157): Utility: Useful for making plants with increased biomass and foliage
  misc_feature (1)..(157): Utility: Useful for making smaller plants
MQIVCVRSASTGGGEEVGEWAEQSSRSALSLFKEKEEEIERKKVEVRDKVFSMLGRVEEETKRLAFIRQELELMADPTRREVDAIRKRIDKVNRQLKPLGKTCLKKEKEYKMCLEAYNEKNNEKATLVNRLLELVSESERLRMKKLEELNKTIESLY

SEQ ID NO: 7627 - protein, 170 aa, Zea mays
  misc_feature (1)..(170): useful for making plants with modified plant phenotypes as described in USSN 12/139,269
  misc_feature (1)..(170): Ceres CLONE ID no. 294598
  misc_feature (1)..(170): Utility: Useful for making plants with increased biomass and foliage
  misc_feature (1)..(170): Utility: Useful for making smaller plants
MQGGGGVDQPPMQMVLRVRHPSSLGGSGADEDDGEGSSRSALSVFKAKEEQIERRKMEVREKVFAHLGRVEEESKRLAFIRQELEGMADPTRKEVESIRKRIDTVNRQLKPLSKSCVKKEKEYKEVLEAYNEKSKEKALLVNRLIELVSESERMRMKKLEELNKTVDSLY

SEQ ID NO: 7628 - protein, 159 aa, Triticum aestivum
  misc_feature (1)..(159): useful for making plants with modified plant phenotypes as described in USSN 12/139,269
  misc_feature (1)..(159): Ceres CLONE ID no. 839270
  misc_feature (1)..(159): Utility: Useful for making plants with increased biomass and foliage
  misc_feature (1)..(159): Utility: Useful for making smaller plants
  misc_feature (101)..(101): Xaa is any aa, unknown or other
  misc_feature (104)..(104): Xaa is any aa, unknown or other
  misc_feature (105)..(105): Xaa is any aa, unknown or other
  misc_feature (112)..(112): Xaa is any aa, unknown or other
  misc_feature (116)..(116): Xaa is any aa, unknown or other
  misc_feature (118)..(118): Xaa is any aa, unknown or other
  misc_feature (141)..(141): Xaa is any aa, unknown or other
  misc_feature (145)..(145): Xaa is any aa, unknown or other
  misc_feature (154)..(154): Xaa is any aa, unknown or other
  misc_feature (157)..(157): Xaa is any aa, unknown or other
  misc_feature (159)..(159): Xaa is any aa, unknown or other
MQMVLRVKHPSSLSSGSEEASEGEGSSRSALSVFKAKEEQIERKKMEVRDKVFAQLGRVEEESKRLAFIRQELEGMADPTRKEVESIQRRIDTVNRQLKPXSKXXVKKEKEXKEIXEXYNEKSKEKAILVNRLIELVSESXRMRXKKLEELNKXVDXLX

SEQ ID NO: 7629 - DNA, 1012 bp, Arabidopsis thaliana
  misc_feature (1)..(1012): useful for making plants with modified plant phenotypes as described in USSN 12/139,269
  misc_feature (1)..(1012): Ceres CLONE ID no. 27810
  misc_feature (1)..(1012): Also known as  Ceres CDNA ID no. 23357720
acaaattgaatttgagaatattaaacgaaaaaacgtttttgcttgagagagaggcgaatctgattcttgtgagagcttccaacaaagtctgcaggctcatcctgcggatcccttcccaatttctcttaggcaggtatcccttcattggcgagatccttgttttcttcgttggggaacagattgcccaaactgaagtctctctctctctgttatggctaaacagagaccggcgacgttgtcagtctacctctacattcccaatatcgttgggtacatgagagttctcttgaactgcattgccttctctgtgtgcttctccaacaagacactcttctccctcttgtactttttcagtttttgttgtgatgctgtggatggatggtgcgctcgtaaatttaaccaagtctctacatttggagctgttttggatatggttacagatagagtcagcacagcctgtcttctcgtgattctctcccagatatacaggcctagcttggttttcctgtcattgctggctttagatatcgctagtcactggctgcaaatgtacagtaccttcctatcagggaagaccagccataaggatgtgaaagatagcacgagctggctctttagactctattatggaaaccggatgttcatgggttattgctgtgtttcctgcgaggttctttatataatccttcttctcatagcaacgaaccaaaccgaaaacttgatgaacgtggtagtgaaatcattgatgcagatttcaccgctctctttactcttggctttgagcatatttggttggtccatcaagcagatcatcaatgtgattcagatgaaaacggctgcagatgtttgtgtcctgtatgacatagagaaacagcataagaagccttgacgttatgtgcccgtgaatcgtgtttaactcttttgtttcatgttgtgtacgacactgtacatacggatccatcttgtttagtatgtagataaactcttgtctttaaatccattcactattttc

SEQ ID NO: 7630 - protein, 225 aa, Arabidopsis thaliana; identical to SEQ ID NO: 7393
  misc_feature (1)..(225): useful for making plants with modified plant phenotypes as described in USSN 12/139,269
  misc_feature (42)..(209): Pfam Name: CDP-OH_P_transf; Pfam Description: CDP-alcohol phosphatidyltransferase
  misc_feature (1)..(225): Utility: Useful for making smaller plants

SEQ ID NO: 7631 - protein, 227 aa, Arabidopsis thaliana; identical to SEQ ID NO: 7392
  misc_feature (1)..(227): useful for making plants with modified plant phenotypes as described in USSN 12/139,269
  misc_feature (1)..(227): Public GI no. 21745398
  misc_feature (1)..(227): Utility: Useful for making smaller plants

SEQ ID NO: 7632 - protein, 227 aa, Arabidopsis thaliana
  misc_feature (1)..(227): useful for making plants with modified plant phenotypes as described in USSN 12/139,269
  misc_feature (1)..(227): Public GI no. 22655196
  misc_feature (1)..(227): Utility: Useful for making smaller plants
MAKKERPRPEKLSVYLYIPNIVGYMRVLLNCVAFAVCFSNKPLFSVLYFFSFCCDAVDGWVARRFNQVSTFGAVLDMVTDRVSTACLLVILSQIYRPSLVFLSLLALDIASHWLQMYSTFLAGKSSHKDVKDSTSWLFRLYYGNRIFMCYCCVSCEVLYIILLLIAKNQSENLLNVVVATLTQISPLSFLLALTLFGWSMKQTINVIQMKTAADVCVLYDIEKQQKP

SEQ ID NO: 7633 - protein, 203 aa, Arabidopsis thaliana
  misc_feature (1)..(203): useful for making plants with modified plant phenotypes as described in USSN 12/139,269
  misc_feature (1)..(203): Ceres CLONE ID no. 34210
  misc_feature (1)..(203): Utility: Useful for making smaller plants
MRVLLNCVAFAVCFSNKPLFSVLYFFSFCCDAVDGWVARRFNQVSTFGAVLDMVTDRVSTACLLVILSQIYRPSLVFLSLLALDIASHWLQMYSTFLAGKSSHKDVKDSTSWLFRLYYGNRIFMCYCCVSCEVLYIILLLIAKNQSENLLNVVVATLTQISPLSFLLALTLFGWSMKQTINVIQMKTAADVCVLYDLEKQQKP

SEQ ID NO: 7634 - protein, 227 aa, Arabidopsis thaliana; identical to SEQ ID NO: 7391
  misc_feature (1)..(227): useful for making plants with modified plant phenotypes as described in USSN 12/139,269
  misc_feature (1)..(227): Public GI no. 21592927
  misc_feature (1)..(227): Utility: Useful for making smaller plants

SEQ ID NO: 7635 - protein, 227 aa, Glycine max; identical to SEQ ID NO: 7396
  misc_feature (1)..(227): useful for making plants with modified plant phenotypes as described in USSN 12/139,269
  misc_feature (1)..(227): Ceres CLONE ID no. 581207
  misc_feature (1)..(227): Utility: Useful for making smaller plants

SEQ ID NO: 7636 - protein, 223 aa, Glycine max; identical to SEQ ID NO: 7401
  misc_feature (1)..(223): useful for making plants with modified plant phenotypes as described in USSN 12/139,269
  misc_feature (1)..(223): Public GI no. 50904897
  misc_feature (1)..(223): Utility: Useful for making smaller plants

SEQ ID NO: 7637 - protein, 223 aa, Glycine max; identical to SEQ ID NO: 7402
  misc_feature (1)..(223): useful for making plants with modified plant phenotypes as described in USSN 12/139,269
  misc_feature (1)..(223): Public GI no. 13661020
  misc_feature (1)..(223): Utility: Useful for making smaller plants

SEQ ID NO: 7638 - protein, 215 aa, Glycine max; identical to SEQ ID NO: 7400
  misc_feature (1)..(215): useful for making plants with modified plant phenotypes as described in USSN 12/139,269
  misc_feature (1)..(215): Public GI no. 34577127
  misc_feature (1)..(215): Utility: Useful for making smaller plants

SEQ ID NO: 7639 - protein, 149 aa, Zea mays
  misc_feature (1)..(149): useful for making plants with modified plant phenotypes as described in USSN 12/139,269
  misc_feature (1)..(149): Ceres CLONE ID no. 284101
  misc_feature (1)..(149): Utility: Useful for making smaller plants
MVTDRVSTACLLALLSQFYRPGLVFLILLGLDITSHWFQMYSSFLSGKTSHKDVKHTGNWLLKLYYGYRPFMAFCCVSCEVLYIFLFLFADEESTSLLSVCKGILNQSPVVILVFVSTLVGWAVKQATNVIQMKTAADACVVYDLKRSK

SEQ ID NO: 7640 - protein, 149 aa, Zea mays; identical to SEQ ID NO: 7639
  misc_feature (1)..(149): useful for making plants with modified plant phenotypes as described in USSN 12/139,269
  misc_feature (1)..(149): Ceres CLONE ID no. 259619
  misc_feature (1)..(149): Utility: Useful for making smaller plants

SEQ ID NO: 7641 - protein, 152 aa, Zea mays
  misc_feature (1)..(152): useful for making plants with modified plant phenotypes as described in USSN 12/139,269
  misc_feature (1)..(152): Ceres CLONE ID no. 306792
  misc_feature (1)..(152): Utility: Useful for making smaller plants
MVTDRVSTACLLALLSQFYRPGLVFLILLGLDITSHWFQMYSSFLSGKTSHKDVKHTGNWLLKLYYGYRPFMAFCCVSCEVLYIILFLFADEKSTSLLSACKGLLNQSPIIILVFISTLVGWAVKQVTNVIQMKTAADACVVYDLKRSKRKA

SEQ ID NO: 7642 - protein, 152 aa, Zea mays; identical to SEQ ID NO: 7641
  misc_feature (1)..(152): useful for making plants with modified plant phenotypes as described in USSN 12/139,269
  misc_feature (1)..(152): Ceres CLONE ID no. 321760
  misc_feature (1)..(152): Utility: Useful for making smaller plants

SEQ ID NO: 7643 - DNA, 690 bp, Arabidopsis thaliana
  misc_feature (1)..(690): useful for making plants with modified plant phenotypes as described in USSN 12/139,269
  misc_feature (1)..(690): Ceres CLONE ID no. 40708
  misc_feature (1)..(690): Also known as  Ceres CDNA ID no. 23382144
cctaatcgaaaagtctcgtctctctctctctctctttgtctccgccatgacaagctcttcatctcctgcacgcaaggcgttaagcaagatcgcgtgtaataggttacaaaaggagttatcagagtggcaagtaaatccaccgactgggtttaagcacagagttactgataatctccaaaaatgggtaattgaggtaacaggagcacctggtacgctttacgctaatgaaacttataatcttcaggttgagtttcctcaacattatcctatggaagctcctcaggtgatttttgttccaccagctccgttacatcctcatatttacagcaatggacatatttgtttagatattctgtatgactcatggtctccagcaatgacagtgagttcagtctgtatcagcattctctcgatgctatcaagttcacccgaaaagcaacgccccactgataatgatcgatatgtgaagaactgcaagaacgggaggtctcctaaagagacaaggtggtggttccatgacgacaaggtttaatgatgacgaccttaagatgtctctcctttcagttacaaaagaggtttatataatttcccaagactgataatactaattgaaattcctcatggcctcccacttttttttctgtaacggatcattatgtataaatgacatctgaaatgtttcagtgtctg

SEQ ID NO: 7644 - protein, 161 aa, Arabidopsis thaliana
  misc_feature (1)..(161): useful for making plants with modified plant phenotypes as described in USSN 12/139,269
  misc_feature (19)..(158): Pfam Name: UQ_con; Pfam Description: Ubiquitin-conjugating enzyme
  misc_feature (1)..(161): Utility: Useful for making smaller plants
  misc_feature (1)..(161): Utility: Useful for modifying plant structure, ie increased branching
MTSSSSPARKALSKIACNRLQKELSEWQVNPPTGFKHRVTDNLQKWVIEVTGAPGTLYANETYNLQVEFPQHYPMEAPQVIFVPPAPLHPHIYSNGHICLDILYDSWSPAMTVSSVCISILSMLSSSPEKQRPTDNDRYVKNCKNGRSPKETRWWFHDDKV

SEQ ID NO: 7645 - protein, 161 aa, Glycine max
  misc_feature (1)..(161): useful for making plants with modified plant phenotypes as described in USSN 12/139,269
  misc_feature (1)..(161): Ceres CLONE ID no. 670593
  misc_feature (1)..(161): Utility: Useful for making smaller plants
  misc_feature (1)..(161): Utility: Useful for modifying plant structure, ie increased branching
MTSSSAAARKNLSKIACNRLQKELVEWQVNPPTGFKHKVTDNLQRWVVEVTGAPGTLYANETYQLQVDFPENYPMEAPQVIFLHPAPLHPHIYSNGHICLDILYDSWSPAMTVSSICISILSMLSSSTTKQRPEDNDRYVKNCRNGRSPKETRWWFHDDKV

SEQ ID NO: 7646 - protein, 161 aa, Zea mays
  misc_feature (1)..(161): useful for making plants with modified plant phenotypes as described in USSN 12/139,269
  misc_feature (1)..(161): Ceres CLONE ID no. 387067
  misc_feature (1)..(161): Utility: Useful for making smaller plants
  misc_feature (1)..(161): Utility: Useful for modifying plant structure, ie increased branching
MTSSSSPSRKALSKIACNRLQKELAEWQLSPPAGFKHKVSDNLQRWVIEVTGAAGTLYAGETYKLQVDFPEHYPMEAPQVIFLHPAPMHPHIYSNGHICLDILYDSWSPAMTVSSICISILSMLSSSPEKQRPADNDRYVKNCRNGRSPKETRWWFHDDTV

SEQ ID NO: 7647 - protein, 161 aa, Arabidopsis thaliana
  misc_feature (1)..(161): useful for making plants with modified plant phenotypes as described in USSN 12/139,269
  misc_feature (1)..(161): Ceres CLONE ID no. 27375
  misc_feature (1)..(161): Utility: Useful for making smaller plants
  misc_feature (1)..(161): Utility: Useful for modifying plant structure, ie increased branching
MSSSGAPSRKTLSKIATNRLQKELVEWQMNPPTGFKHKVTDNLQRWIIEVIGAPGTLYANDTYQLQVDFPEHYPMESPQVIFLHPAPLHPHIYSNGHICLDILYDSWSPAMTVSSICISILSMLSSSTEKQRPTDNDRYVKNCKNGRSPKETRWWFHDDKV

SEQ ID NO: 7648 - protein, 161 aa, Zea mays
  misc_feature (1)..(161): useful for making plants with modified plant phenotypes as described in USSN 12/139,269
  misc_feature (1)..(161): Ceres CLONE ID no. 280334
  misc_feature (1)..(161): Utility: Useful for making smaller plants
  misc_feature (1)..(161): Utility: Useful for modifying plant structure, ie increased branching
MTSSSSPSRKALSKIACNRLQKELAEWQLSPPAGFKHKVSDNLQRWVIEVTGAAGTLYAGETYQLQVDFPEHYPMEAPQVIFLNPAPMHPHIYSNGHICLDILYDSWSPAMTVSSVCISILSMLSSSPAKQRPVDNDRYVRNCRNGRSPKETRWWFHDDTV

SEQ ID NO: 7649 - protein, 156 aa, Brassica napus
  misc_feature (1)..(156): useful for making plants with modified plant phenotypes as described in USSN 12/139,269
  misc_feature (1)..(156): Ceres CLONE ID no. 1256091
  misc_feature (1)..(156): Utility: Useful for making smaller plants
  misc_feature (1)..(156): Utility: Useful for modifying plant structure, ie increased branching
  misc_feature (3)..(3): Xaa is any aa, unknown or other
  misc_feature (4)..(4): Xaa is any aa, unknown or other
  misc_feature (5)..(5): Xaa is any aa, unknown or other
  misc_feature (92)..(92): Xaa is any aa, unknown or other
  misc_feature (112)..(112): Xaa is any aa, unknown or other
MRXXXRKIACNRLQKELTEWQLNPPTGFRHKVTDNLQKWTIDVTGAPGTLYANETYQLQVEFPVNYPMEAPQVIFVPPAPSHPHIYSNGHIXLDILYDSWSPAMTVSSVCIXILSMLSSSPAKERPADNDRYVKNCKNGRSPKGDEVVASMTTRLD

SEQ ID NO: 7650 - protein, 161 aa, Triticum aestivum
  misc_feature (1)..(161): useful for making plants with modified plant phenotypes as described in USSN 12/139,269
  misc_feature (1)..(161): Ceres CLONE ID no. 677474
  misc_feature (1)..(161): Utility: Useful for making smaller plants
  misc_feature (1)..(161): Utility: Useful for modifying plant structure, ie increased branching
MTSSSTPSRKALSKIACNRLQKELAEWQVGPPAGFKYKVSDNLQRWVIEVGGAEGTLYAGETYQLQVDFPEHYPMEAPQVIFLNPAPMHPHIYSNGHICLDILYDSWSPAMTVSSVCISILSMLSSSPAKQRPADNDRYVRNCRNGRSPKETRWWFHDDKV

SEQ ID NO: 7651 - protein, 163 aa, Triticum aestivum
  misc_feature (1)..(163): useful for making plants with modified plant phenotypes as described in USSN 12/139,269
  misc_feature (1)..(163): Ceres CLONE ID no. 618269
  misc_feature (1)..(163): Utility: Useful for making smaller plants
  misc_feature (1)..(163): Utility: Useful for modifying plant structure, ie increased branching
MTSSASSSPSRKVLSKIACLRLQKELGEWQASPPGGFTYKVSDNLQRWVIEVSGAEGTLYAGETYRLQVDFPEQYPMEAPQVIFMHPAPMHPHIYSNGHICLDILYDSWSPAMTVSSVCISILSMLSSSPAKERPSDNDRYVRNCRNGRSPKETRWWFHDDKV

SEQ ID NO: 7652 - protein, 137 aa, Arabidopsis thaliana
  misc_feature (1)..(137): useful for making plants with modified plant phenotypes as described in USSN 12/139,269
  misc_feature (1)..(137): Ceres CLONE ID no. 40968
  misc_feature (1)..(137): Utility: Useful for making smaller plants
  misc_feature (1)..(137): Utility: Useful for modifying plant structure, ie increased branching
MEWQTNPPSGFKHRVSDNLQRWIIEVHGVPGTLYANETYQLQVEFPEHYPMEAPQVIFQHPAPLHPHIYSNGHICLDVLYDSWSPAMRLSSICLSILSMLSSSSVKQKPKDNDHYLKNCKHGRSPKETRWRFHDDKV

SEQ ID NO: 7653 - protein, 159 aa, Arabidopsis thaliana
  misc_feature (1)..(159): useful for making plants with modified plant phenotypes as described in USSN 12/139,269
  misc_feature (1)..(159): Ceres CLONE ID no. 113577
  misc_feature (1)..(159): Utility: Useful for making smaller plants
  misc_feature (1)..(159): Utility: Useful for modifying plant structure, ie increased branching
MSSSGAPSRKTLSKIATNRLQKELVEWQMNPPTGFKHKVTDNLQRWIIEVIGAPGTLYANDTYQLQVDFPEHYPMESPQVIFLHPAPLHPHIYSNGHICLDILYDSWSPAMTVSSICISILSITAGSTRGKDLIGWRITRCSRIHRRWMKEILITTRNR

SEQ ID NO: 7654 - DNA, 1504 bp, Arabidopsis thaliana
  misc_feature (1)..(1504): useful for making plants with modified plant phenotypes as described in USSN 12/139,269
  misc_feature (1)..(1504): Ceres CLONE ID no. 116117
  misc_feature (1)..(1504): Also known as  Ceres CDNA ID no. 23363771
atcttcgcttgcttcctcctcaaaaggtgaaaaattagagcgagagagatagagagagatttcaaaacgaaaatccagagaaagggtcttgccagtttagggcatccttgtgggtgagagagcgattgagagatttcaaaaggaggaagaggaagatacgagtgtgagagagatttagagggagagaagaaagagagattctttttgagtgtgttagggtttcatttcctctgcagatctacatttatctcttctcatggaacggaagcttgtggttttgggaatcccgtgggatattgattccgatgggcttaaggattacatgtcaaaatttggagacttggaggattgtattgtcatgaaggatcgatcaactggaagatctcgtggatttggatatgtcacttttgcttcagccgaagatgcaaagaatgctttgaaaggtgaacactttttagggaacaggatcttggaagttaaagtggctacaccaaaggaagagatgagacagcctgcaaaaaaagtgacgaggatcttcgttgctcgaatcccttcatcagtctctgaatcagatttccgaagccattttgagaggtatggggaaataacagacttatacatgcctaaggactacaactcgaagcagcaccgacgaatagggtttatcacattctctagtgctgattcagtggaggatctgatggaggacactcatgatctgggaggtacaacagttgctgttgatcgggcaacaccaaaagaggatgatcatccgcctaggccaccgccagtggctagaatgtcgcgcccacccgtggctattgcaggtggatttggagctccaggtggttatggagcttatgatgcttacatttctgcagctacaagatacgcagcgcttggtgcccctactttgtatgataatcccgccacgttttatggaagaggggaaccaaccacaaggggaataggaaacaagatctttgttggacggcttcctcaagaagcatccgttgatgatcttcgcgattattttgggagatttggccatattcaagatgcttatattccaaaggacccaaagagaagtggacatagaggttttggatttgttacctttgctgaaaatggtgttgcagatcgtgtagcccgaagatctcatgaaatctgtggacaagaggtagcaatagattcagcaacgcctcttgatgaagctggacctagcgctggcgcaagttccatgttaagttcttctcgtcctgaatattttggtggctatggaggtcctatgcgcgcatttggtcgaatgtatggaggcatgagcttggacgattggggatatggaatgccaaacgcaagaccatcaagaccagaccggaggtaccggccatactaatgcagcagaccaacatttcattagctttggctttgtctttttatagaaacttcactttgtcagatctattttaattgaagcttttgtttatgttttaccctcggaacc

SEQ ID NO: 7655 - protein, 379 aa, Arabidopsis thaliana
  misc_feature (1)..(379): useful for making plants with modified plant phenotypes as described in USSN 12/139,269
  misc_feature (5)..(74): Pfam Name: RRM_1; Pfam Description: RNA recognition motif. (a.k.a. RRM, RBD, or RNP domain)
  misc_feature (1)..(379): Utility: Useful for making smaller plants
MERKLVVLGIPWDIDSDGLKDYMSKFGDLEDCIVMKDRSTGRSRGFGYVTFASAEDAKNALKGEHFLGNRILEVKVATPKEEMRQPAKKVTRIFVARIPSSVSESDFRSHFERYGEITDLYMPKDYNSKQHRRIGFITFSSADSVEDLMEDTHDLGGTTVAVDRATPKEDDHPPRPPPVARMSRPPVAIAGGFGAPGGYGAYDAYISAATRYAALGAPTLYDNPATFYGRGEPTTRGIGNKIFVGRLPQEASVDDLRDYFGRFGHIQDAYIPKDPKRSGHRGFGFVTFAENGVADRVARRSHEICGQEVAIDSATPLDEAGPSAGASSMLSSSRPEYFGGYGGPMRAFGRMYGGMSLDDWGYGMPNARPSRPDRRYRPY

SEQ ID NO: 7656 - protein, 339 aa, Glycine max
  misc_feature (1)..(339): useful for making plants with modified plant phenotypes as described in USSN 12/139,269
  misc_feature (1)..(339): Ceres CLONE ID no. 467735
  misc_feature (1)..(339): Utility: Useful for making smaller plants
MSKFGELEDCIVMKERSTGRSRGFGYVTFASVDDAKEVLSSEHILGNRTLEVKVATPKEEMRAPVKKVTRIFVARIPQSVTEATFRSHFEKYGEITDLYMPKDQGSKMHRGIGFITFASADSVENLMSETHELGGSAVVVDRATPKDDDFKPIGRMPLPPPTQGGYGAYNAYISAATRYAALGAPTLYDQPGPIYGRGDPSRRTSKKIFVGRLPPEATSDDLRQYFGRFGRILDVYVPRDPKRTGHRGFGFVTFAEDGVADRVSRRSHEICGHQVAIDSATPVDDAGPSGNFMMNSMESFGGYGGPVRSYGRMYGSLDFDDWGYGIGRPSRADWRYRPY

SEQ ID NO: 7657 - protein, 358 aa, Zea mays
  misc_feature (1)..(358): useful for making plants with modified plant phenotypes as described in USSN 12/139,269
  misc_feature (1)..(358): Ceres CLONE ID no. 333643
  misc_feature (1)..(358): Utility: Useful for making smaller plants
MKLVVLGIPWDVDTEGLREYMAKFGPLDDCVVMKERSSGRSRGFGYVTFASADDAKNVLDCEHVLGSRTLEVKVATPKEEMKSQGSKKATRIFVARIPQSVDESMFRRHFEAFGEILDLYMPKEHGSKGHRGIGFITFQSAESVDNIMQESHELDGTTVVVDRATPKDEDVRYPPSRPSQGGYGAYNAYISAATRYATLGAPTLYDHPGSAYGRGYYGPSQAVGKKIFVGRLPQEANTDDLRQYFGRFGRIVDAYIPKDPKRSGHRGFGFVTFADDGVAERVARRSHEILGHEVAIDTAAPLENDSAAGGYIDPMDLYGAYGSMRSFGRFCGGLDYNYGYGPSSGSSRSRSDWRYRPY

SEQ ID NO: 7658 - protein, 363 aa, Zea mays
  misc_feature (1)..(363): useful for making plants with modified plant phenotypes as described in USSN 12/139,269
  misc_feature (1)..(363): Public GI no. 57899379
  misc_feature (1)..(363): Utility: Useful for making smaller plants
MATKLVVLGIPWDVDTEGLREYMGKFGPLDDCVVMKERSSGRSRGFGYVTFSSADDAKNVLECEHVLGNRTLEVKIATPKEEMKSQGSKKATRIFVARIPQSVDESMFRRHFEAYGEITDLYMPKEHGSKGHRGIGFITFQSAESVDSIMQDSHELDGTTVVVDRATPKDEEVRYPPSRGASQGGYGAYNAYISAATRYAALGAPTLYDHPGSAYGRGGYYGSSQGMGNKKIFVGRLPQEANTEDLRHYFGKFGRIVDAYIPKDPKRSGHRGFGFVTFADEGVADRVARRSHEILGHEVAIDTAAPLEGDSGGGYMEPMDLYGAYGSMRTYGRFCSGIDYDYGYGHSGSSSSRSRADWRYRPY

SEQ ID NO: 7659 - DNA, 1334 bp, Glycine max
  misc_feature (1)..(1334): useful for making plants with modified plant phenotypes as described in USSN 12/139,269
  misc_feature (1)..(1334): Ceres CLONE ID no. 538933
  misc_feature (1)..(1334): Also known as  Ceres CDNA ID no. 23694939
tcttctaaccagtatcacctacacggtgtgtgtgtcccttcatcctggaaattagagccacaaacataacacattccgctttgactttggaggcaggtttttgtgctttgtctggttcccaatcaccgtgatatcatggaatccccacaatctgttgtgtcaccattcaagaggtctgtcttgggtgatgcagagaagtataggtctgatgttctgtctaaggacattgaagtcaatggaaaggaaggtgccgtgtgtaatgtggaggaattcattggtgttgttgatgtttacattcatcaggccagggacattcataacatctgcatataccacaagcaagatgtttatgctaagatttgtttgactagtaatcctgagaatactgtctctaccaagaccatcaatggaggaggaaggaaccccgtgtttaatgagaatcttagtctaagcgttaggactgttgattctgtagtcaaatgtgaaatttggatgctgagcagggtgaagaattatcttgaagatcagttgcttggttttgctttggtgcctttgtctgaagtactggtgaagaaggatggcaaactagagaaagagttctctctttcttcaactgatctattccattctccagccggttatgttcaattgtctcttgcttacactggtgcttcgcctgatgttatggcaatttcttcaatgcctaccaccgagaaggactccgaatcatgcgagtcactggtcagagatttggacaaaatcgaattcccggatccaaaaattgtaaatgaagaccacttgatggtttcggaatacttcggcattccatgtgaggagagccagtgttctgatagcttgaccactactgatactgaaaatcttagttctgaagcaggtgttcagcttgtggagagcttctcagcatgcagtgttagcagtgtgtcaacaaatggggtttcatctccttcagtggctgcaagctcagactcgtctcccaatgaggaaaccaaagagaaaaatgtggatgtcaaagatggtgagactgattcctcgttccctaaacctcttgtgactgttaacatcgagccggagccgaatgtggtgcagcaggattttgtagacatgtacatgaaaagcatgcagcaattcaccgagtcattggcaaaaatgaagcttcctgtggactttgaaagtggaccaactagttcaggaaactctagctctgaacacaagctacagacaccaaagagcactaactcccgtgtgttttatggcagcagggctttcttctgaactttttgatcaagggaatactttcaggtgacttagatttt

SEQ ID NO: 7660 - protein, 385 aa, Glycine max
  misc_feature (1)..(385): useful for making plants with modified plant phenotypes as described in USSN 12/139,269
  misc_feature (50)..(137): Pfam Name: C2; Pfam Description: C2 domain
  misc_feature (1)..(385): Utility: Useful for making smaller plants
MESPQSVVSPFKRSVLGDAEKYRSDVLSKDIEVNGKEGAVCNVEEFIGVVDVYIHQARDIHNICIYHKQDVYAKICLTSNPENTVSTKTINGGGRNPVFNENLSLSVRTVDSVVKCEIWMLSRVKNYLEDQLLGFALVPLSEVLVKKDGKLEKEFSLSSTDLFHSPAGYVQLSLAYTGASPDVMAISSMPTTEKDSESCESLVRDLDKIEFPDPKIVNEDHLMVSEYFGIPCEESQCSDSLTTTDTENLSSEAGVQLVESFSACSVSSVSTNGVSSPSVAASSDSSPNEETKEKNVDVKDGETDSSFPKPLVTVNIEPEPNVVQQDFVDMYMKSMQQFTESLAKMKLPVDFESGPTSSGNSSSEHKLQTPKSTNSRVFYGSRAFF

SEQ ID NO: 7661 - protein, 384 aa, Glycine max
  misc_feature (1)..(384): useful for making plants with modified plant phenotypes as described in USSN 12/139,269
  misc_feature (1)..(384): Ceres CLONE ID no. 470921
  misc_feature (1)..(384): Utility: Useful for making smaller plants
MSNVEEFLGVLDVYIHQARDIQNICIYHKQDVYAKISLTSNPETTMSTKTINGGGRNPVFNENLRIDVRTVDASLKCEIWMLSRVKNYLEDQLLGFALVPLSEVLVQNGKLEKEFSLSSTDLFHSPSGFVQLSLSYTGASPDVMAISAMPNKVATDGTVQDSDTSESLARDLDKIEFPDPKIVNEDHLMVSEYFGIRCEETQCSDSLATSDAENHSSEAGVQLVESFSACSVESVQPTKVDSPPSSVSTNGVSSPSVPANSESSDAAAAASKSPIQEQVSGTKEDKNVDAKDGESDSSCGVPIDSFPKPVVSVNIEPEPKVVQQDIVDMYMKSMQQFTESLAKMKLPMDLESEPTSSGNSTTEQKLQPSKSNNSRVFYGSRAFF

SEQ ID NO: 7662 - protein, 212 aa, Arabidopsis thaliana
  misc_feature (1)..(212): useful for making plants with modified plant phenotypes as described in USSN 12/139,269
  misc_feature (1)..(212): Ceres CLONE ID no. 1367041
  misc_feature (1)..(212): Utility: Useful for making smaller plants
MDSPQSVVSPFKIGESENENSNSVQSSGNQSNGINSNGKDSKSCGRQDLVGALEVYVHQARDIHNICIYHKQDVYAKLCLTSDPDKSVSTKIINGGGRNPVFDDNVKLDVRVLDTSLKCEIYMMSRVKNYLEDQLLGFTLVPMSELLFKNGKLEKEFSLSSTDLYHSPAGFVQLSLSYYGSYPDVMAIPSMPSSVSIDETTKDPEGSESVSG

SEQ ID NO: 7663 - protein, 112 aa, Zea mays
  misc_feature (1)..(112): useful for making plants with modified plant phenotypes as described in USSN 12/139,269
  misc_feature (1)..(112): Ceres CLONE ID no. 1557119
  misc_feature (1)..(112): Utility: Useful for making smaller plants
MAATYQTGLVAEPQLLNTEIITRRATNCVADTNRKDKCVGYLDVFVHQARDIHNVCIYHKQDVYAKLCLTSSPDVSCSTKVINSAGRNPVFEESLRLDVQTVDALSSARYGC

SEQ ID NO: 7664 - protein, 77 aa, Triticum aestivum
  misc_feature (1)..(77): useful for making plants with modified plant phenotypes as described in USSN 12/139,269
  misc_feature (1)..(77): Ceres CLONE ID no. 763949
  misc_feature (1)..(77): Utility: Useful for making smaller plants
MESQQKQQMEAVSAPAATNGGGELIGYVDVHVRSARDIQNICIYHKQDVYARLSLPGEGAPAASTQVINGGGRNPVF

SEQ ID NO: 7665 - protein, 283 aa, Arabidopsis thaliana
  misc_feature (1)..(283): useful for making plants with modified plant phenotypes as described in USSN 12/139,269
  misc_feature (1)..(283): Ceres CLONE ID no. 113269
  misc_feature (1)..(283): Utility: Useful for making smaller plants
MMSRVKNYLEDQLLGFTLVPMSELLFKNGKLEKEFSLSSTDLYHSPAGFVQLSLSYYGSYPDVMAIPSMPSSVSIDETTKDPEGSESVPGELDKIEFPDPNVANENEKMVSEYFGISCSTIDSETSDSLVTSDAENHVTNSVTSILKQDSPESSNATNGAASPHASAHSATETPNHEHLSVVNSKASSQESESEASGETSEEKTVKSVLTVKVEPESKVVQQDIVDMYMKSMQQFTDSLAKMKLPLDIDSPTKSENSSSDSQKLPTPKSNNGSRVFYGSRPFF

SEQ ID NO: 7666 - protein, 359 aa, Arabidopsis thaliana
  misc_feature (1)..(359): useful for making plants with modified plant phenotypes as described in USSN 12/139,269
  misc_feature (1)..(359): Ceres CLONE ID no. 115393
  misc_feature (1)..(359): Utility: Useful for making smaller plants
MSSDSDSFIGVLEVFVHQARDIHNICIYHKQDVYAKLCLTNDPENSLSTKIINGGGQNPVFDDTLQFDVKNLDCSLKCEIFMMSRVKNYLEDQLLGFSLVPLSEVIVRNGKLEKEFSLSSTDLYHSPAGFVELSLSYAGDSPDVMHIPAVPTADETELAPIEFDESEFLDPKIVCENNQMVSKYFSTTCSDSDDFASSETGFVEVNSILSAVVETAVDEAAPANTVSTNGISSPSTAVSSGSSGTHDVSKQSSEGNNSDSEQEAKKPTDIIKSGDLDKTDEEAVVKPVLTVHIEPEQKVVQQDIVDMYTKSLQQFTESLAKMKLPLDIDSPTQSENSSSSQQTPKSASSRVFYGSRAFF

SEQ ID NO: 7667 - protein, 262 aa, Zea mays
  misc_feature (1)..(262): useful for making plants with modified plant phenotypes as described in USSN 12/139,269
  misc_feature (1)..(262): Ceres CLONE ID no. 452749
  misc_feature (1)..(262): Utility: Useful for making smaller plants
MAATYQTGLVAEPQLLNTEIITRRATNSVADTNRKDKCVGYLDVFVHQARDIHNVCIYHKQDVYAKLCLTSSPDVSCSTKVINSAGRNPVFEESLRLDVQTVDASLKCEIWMLSRVRNYLEDQLLGFALVPLVDILIGNGKLVQEFSLTSTDLFHTPAGFVHLSLSYAGCSPDVVLISSPNNSPSTVYDSGIDHVVPSQLEKIVFPDLNVEKEDEIMVSKYLEMTSDSETPIKVENGVSLHSANDDDVPSKLEKIKFIDSES

SEQ ID NO: 7668 - protein, 278 aa, Arabidopsis thaliana
  misc_feature (1)..(278): useful for making plants with modified plant phenotypes as described in USSN 12/139,269
  misc_feature (1)..(278): Ceres CLONE ID no. 39481
  misc_feature (1)..(278): Utility: Useful for making smaller plants
MMSRVKNYLEDQLLGFSLVPLSEVIVRNGKLEKEFSLSSTDLYHSPAGFVELSLSYAGDSPDVMHIPAVPTADETELAPIEFDESEFLDPKIVCENNQMVSKYFSTTCSDSDDFASSETGFVEVNSILSAVVETAVDEAAPANTVSTNGISSPSTAVSSGSSRTHDVSKQSSEGNNSDSEQEAKKPTDIIKSGDLDKTDEEAVVKPVLTVHIEPEQKVVQQDIVDMYTKSLQQFTESLAKMKLPLDIDSPTQSENSSSSQQTPKSASSRVFYGSRAFF

SEQ ID NO: 7669 - protein, 432 aa, Triticum aestivum
  misc_feature (1)..(432): useful for making plants with modified plant phenotypes as described in USSN 12/139,269
  misc_feature (1)..(432): Ceres CLONE ID no. 677448
  misc_feature (1)..(432): Utility: Useful for making smaller plants
MEAVSAPAASTNGGGELIGYVDVHVRSARDIQNICIYHKQDVYARLSLPGEGAPAASTQVINGGGRNPVFDQSVRVGVRAGDVDAALRCEVWMLSRVKNYLQDQLLGFALVPLPDVVAAEGGTLAREFPLSTNDLFHSPAGFLELELSYIGVVPDVIPVSPTPKPALADPDECENAGGGAGAGAGKDYENMEFPDMNLVEENQIMLSEYVGLPCTAMETQSSESLLTSEDVDGAATESHDAGVRVVQSFSTDYSTADSAGAFRSETAASSVSTTESPAAAVPATPQSNPSEPSGNALSSAGQKEKASDAAEVDSSPTVQESPAVNSPSTVSENAVDKPPPAMSFNFAEEVQVNQKEIMDMYMKSMQQFTESLAKMKLPLDMDNGSDKSGSGPAAASPTDSSGTDSSAATKKPTAGAAQEKSPKVFYGSRAFF

SEQ ID NO: 7670 - DNA, 557 bp, Arabidopsis thaliana; identical to SEQ ID NO: 5205
  misc_feature (1)..(557): useful for making plants with modified plant phenotypes as described in USSN 12/139,269
  misc_feature (1)..(557): Ceres CLONE ID no. 519
  misc_feature (1)..(557): Also known as  Ceres CDNA ID no. 23364910

SEQ ID NO: 7671 - protein, 93 aa, Arabidopsis thaliana; identical to SEQ ID NO: 5206
  misc_feature (1)..(93): useful for making plants with modified plant phenotypes as described in USSN 12/139,269
  misc_feature (20)..(62): Pfam Name: HLH; Pfam Description: Helix-loop-helix DNA-binding domain
  misc_feature (1)..(93): Utility: Useful for making smaller plants
  misc_feature (1)..(93): Utility: Useful for making taller plants

SEQ ID NO: 7672 - protein, 90 aa, Glycine max; identical to SEQ ID NO: 7196
  misc_feature (1)..(90): useful for making plants with modified plant phenotypes as described in USSN 12/139,269
  misc_feature (1)..(90): Ceres CLONE ID no. 1247092
  misc_feature (1)..(90): Utility: Useful for making smaller plants
  misc_feature (1)..(90): Utility: Useful for making taller plants

SEQ ID NO: 7673 - protein, 94 aa, Glycine max; identical to SEQ ID NO: 7194
  misc_feature (1)..(94): useful for making plants with modified plant phenotypes as described in USSN 12/139,269
  misc_feature (1)..(94): Public GI no. 28416803
  misc_feature (1)..(94): Utility: Useful for making smaller plants
  misc_feature (1)..(94): Utility: Useful for making taller plants

SEQ ID NO: 7674 - protein, 94 aa, Arabidopsis thaliana; identical to SEQ ID NO: 5200
  misc_feature (1)..(94): useful for making plants with modified plant phenotypes as described in USSN 12/139,269
  misc_feature (1)..(94): Ceres CLONE ID no. 18200
  misc_feature (1)..(94): Utility: Useful for making smaller plants
  misc_feature (1)..(94): Utility: Useful for making taller plants

SEQ ID NO: 7675 - protein, 92 aa, Glycine max; identical to SEQ ID NO: 5212
  misc_feature (1)..(92): useful for making plants with modified plant phenotypes as described in USSN 12/139,269
  misc_feature (1)..(92): Ceres CLONE ID no. 653656
  misc_feature (1)..(92): Utility: Useful for making smaller plants
  misc_feature (1)..(92): Utility: Useful for making taller plants

SEQ ID NO: 7676 - protein, 92 aa, Glycine max; identical to SEQ ID NO: 5218
  misc_feature (1)..(92): useful for making plants with modified plant phenotypes as described in USSN 12/139,269
  misc_feature (1)..(92): Ceres CLONE ID no. 663844
  misc_feature (1)..(92): Utility: Useful for making smaller plants
  misc_feature (1)..(92): Utility: Useful for making taller plants

SEQ ID NO: 7677 - protein, 92 aa, Triticum aestivum; identical to SEQ ID NO: 5214
  misc_feature (1)..(92): useful for making plants with modified plant phenotypes as described in USSN 12/139,269
  misc_feature (1)..(92): Ceres CLONE ID no. 733804
  misc_feature (1)..(92): Utility: Useful for making smaller plants
  misc_feature (1)..(92): Utility: Useful for making taller plants

SEQ ID NO: 7678 - protein, 91 aa, Triticum aestivum; identical to SEQ ID NO: 5208
  misc_feature (1)..(91): useful for making plants with modified plant phenotypes as described in USSN 12/139,269
  misc_feature (1)..(91): Ceres CLONE ID no. 703180
  misc_feature (1)..(91): Utility: Useful for making smaller plants
  misc_feature (1)..(91): Utility: Useful for making taller plants

SEQ ID NO: 7679 - protein, 91 aa, Glycine max; identical to SEQ ID NO: 5208
  misc_feature (1)..(91): useful for making plants with modified plant phenotypes as described in USSN 12/139,269
  misc_feature (1)..(91): Ceres CLONE ID no. 560681
  misc_feature (1)..(91): Utility: Useful for making smaller plants
  misc_feature (1)..(91): Utility: Useful for making taller plants

SEQ ID NO: 7680 - protein, 91 aa, Glycine max; identical to SEQ ID NO: 5208
  misc_feature (1)..(91): useful for making plants with modified plant phenotypes as described in USSN 12/139,269
  misc_feature (1)..(91): Ceres CLONE ID no. 562428
  misc_feature (1)..(91): Utility: Useful for making smaller plants
  misc_feature (1)..(91): Utility: Useful for making taller plants

SEQ ID NO: 7681 - protein, 92 aa, Glycine max; identical to SEQ ID NO: 5210
  misc_feature (1)..(92): useful for making plants with modified plant phenotypes as described in USSN 12/139,269
  misc_feature (1)..(92): Ceres CLONE ID no. 560948
  misc_feature (1)..(92): Utility: Useful for making smaller plants
  misc_feature (1)..(92): Utility: Useful for making taller plants

SEQ ID NO: 7682 - protein, 92 aa, Brassica napus; identical to SEQ ID NO: 7170
  misc_feature (1)..(92): useful for making plants with modified plant phenotypes as described in USSN 12/139,269
  misc_feature (1)..(92): Ceres CLONE ID no. 951040
  misc_feature (1)..(92): Utility: Useful for making smaller plants
  misc_feature (1)..(92): Utility: Useful for making taller plants

SEQ ID NO: 7683 - protein, 92 aa, Brassica napus; identical to SEQ ID NO: 5225
  misc_feature (1)..(92): useful for making plants with modified plant phenotypes as described in USSN 12/139,269
  misc_feature (1)..(92): Public GI no. 22331645
  misc_feature (1)..(92): Utility: Useful for making smaller plants
  misc_feature (1)..(92): Utility: Useful for making taller plants

SEQ ID NO: 7684 - protein, 91 aa, Glycine max
  misc_feature (1)..(91): useful for making plants with modified plant phenotypes as described in USSN 12/139,269
  misc_feature (1)..(91): Ceres CLONE ID no. 609713
  misc_feature (1)..(91): Utility: Useful for making smaller plants
  misc_feature (1)..(91): Utility: Useful for making taller plants
MSGQRRSSRTSKFTEIEINELVSRLQVLLLQVNQRGNSRQSASKILQETCCYIRKLQEEVEQLSERLSELMDSVDISDIDRRTLQNLLQQY

SEQ ID NO: 7685 - DNA, 665 bp, Arabidopsis thaliana
  misc_feature (1)..(665): useful for making plants with modified plant phenotypes as described in USSN 12/139,269
  misc_feature (1)..(665): Ceres CLONE ID no. 4309
  misc_feature (1)..(665): Also known as  Ceres CDNA ID no. 23384015
aacatatcacaacagagttgagtgagaaagaataagggattagaaaaagagagaatgggtaaggacaacaccagaatcctcatgcaattttcagctctcgcgatggttttaacagctgcaataatggtgaaagaagctacaagcattcccgtttgcaacattgacacaaacgacttggcgaaatgccgtccagccgtcactggaaacaaccctccaccaccgggaccggactgctgcgcagtggccagagttgctaatctacaatgcctctgcccgtacaagccttatctccccactgtcgggatagacccatctagagtcaggcctcttcttgccaattgtggtgtaaacagtccttcctgtttctaagcatgaagaactgacctgaagtcaggcccagtctcccacagactttgtcttgccctgaagtctctaagctataaatatgtcttttgctgttctgattcgcataaatatcaactttgcagtgatttttcagtcaccttatctattatatagatgaaccatgttctactgttaatgaaatgaaataaagtacttgtttttttgctaactccattgtgtactactttcttgagtatttaaaaattgactccttatgtatcttccgtgcaaagaacccaaatcataatattaagagatgc

SEQ ID NO: 7686 - protein, 104 aa, Arabidopsis thaliana
  misc_feature (1)..(104): useful for making plants with modified plant phenotypes as described in USSN 12/139,269
  misc_feature (34)..(103): Pfam Name: Tryp_alpha_amyl; Pfam Description: Protease inhibitor/seed storage/LTP family
  misc_feature (34)..(103): Pfam Name: Tryp_alpha_amyl; Pfam Description: Protease inhibitor/seed storage/LTP family
  misc_feature (1)..(104): Utility: Useful for making smaller plants
MGKDNTRILMQFSALAMVLTAAIMVKEATSIPVCNIDTNDLAKCRPAVTGNNPPPPGPDCCAVARVANLQCLCPYKPYLPTVGIDPSRVRPLLANCGVNSPSCF

SEQ ID NO: 7687 - DNA, 524 bp, Arabidopsis thaliana
  misc_feature (1)..(524): useful for making plants with modified plant phenotypes as described in USSN 12/139,269
  misc_feature (1)..(524): Ceres CLONE ID no. 11843
  misc_feature (1)..(524): Also known as  Ceres CDNA ID no. 23381280
gtcttctttcttcttcacttctgcctcttagggttaagcaagagagaaactagagatgaggttgataacgcacaacatgctttcctgcaacatcaaaggagtcaccagtggatttcctctacggatcgaagctgggaacgtgattgagaaggaagtcgatttcaatcccgattttatcaggcacatgttcgcgaagattgagtggaaagctctggtggaaggtgcgcgttccatgggatacgctgagttaccggaggaatctccggacgccgcggtgctgaaatcagatgagcccttccttaagaaactccaccacgcgttgctcgagctccaccttgaggaaggcgcgcttgtttgccctgagactggacggaagtttccggttaataaaggaatcccaaatatgcttctccatgaagacgaggtttaattgattgtgagatttttccttgtaagtttcaatctatgatgtttctgatgatgtgaaccttttagtgagatatgcaattgaatgattccatttg

SEQ ID NO: 7688 - protein, 124 aa, Arabidopsis thaliana
  misc_feature (1)..(124): useful for making plants with modified plant phenotypes as described in USSN 12/139,269
  misc_feature (2)..(124): Pfam Name: DUF343; Pfam Description: Protein of unknown function (DUF343)
  misc_feature (1)..(124): Utility: Useful for making smaller plants
MRLITHNMLSCNIKGVTSGFPLRIEAGNVIEKEVDFNPDFIRHMFAKIEWKALVEGARSMGYAELPEESPDAAVLKSDEPFLKKLHHALLELHLEEGALVCPETGRKFPVNKGIPNMLLHEDEV

SEQ ID NO: 7689 - protein, 123 aa, Brassica napus
  misc_feature (1)..(123): useful for making plants with modified plant phenotypes as described in USSN 12/139,269
  misc_feature (1)..(123): Ceres CLONE ID no. 1088130
  misc_feature (1)..(123): Utility: Useful for making smaller plants
MLSCNIKGVTNGFPLKIEAEKVVEKEVDFNPDFLRHMFAKIEWKALVEAARSMGYAELPEDSPDATVIDSADETFLRKLHHALLELHLEEGALVCPETGRKFPVNKGIPNMLLHEDEVNSIKS

SEQ ID NO: 7690 - protein, 118 aa, Brassica napus
  misc_feature (1)..(118): useful for making plants with modified plant phenotypes as described in USSN 12/139,269
  misc_feature (1)..(118): Ceres CLONE ID no. 946134
  misc_feature (1)..(118): Utility: Useful for making smaller plants
  misc_feature (118)..(118): Xaa is any aa, unknown or other
MLSCNIKGVKNGFPLKIEAEKVIEKEVDFNPDFLRHMFAKIEWKALVEAARSMGYAELPEDSPDATVIESADETFLRKLHHALLELHLEEGALVCPETGRKFPVNKGIPNMLLHEDEX

SEQ ID NO: 7691 - protein, 126 aa, Brassica napus
  misc_feature (1)..(126): useful for making plants with modified plant phenotypes as described in USSN 12/139,269
  misc_feature (1)..(126): Ceres CLONE ID no. 1085859
  misc_feature (1)..(126): Utility: Useful for making smaller plants
MRLITHNMLSCNIKGVTNGFPLKVEAEKVIEKEIDFNPDFLRHMFAKIEWKALVEAACSLGYAELPEDSPDATVIESAADESLLKKLHHALLELHLEEGALVCPETGRKFPVNKGIPNMLLHEDEV

SEQ ID NO: 7692 - protein, 124 aa, Brassica napus
  misc_feature (1)..(124): useful for making plants with modified plant phenotypes as described in USSN 12/139,269
  misc_feature (1)..(124): Public GI no. 47606209
  misc_feature (1)..(124): Utility: Useful for making smaller plants
MRLIVHNMLSCNIKGVVNKFPLRIEAEKVTVKEVDFNPDFLRYMFAKIDWKALVDGARSMEYTELPDNAPDTTTLESDETFLRKFHHALLELHLEEGSLVCPETGRKFSVSKGIPNMLLHEDEV

SEQ ID NO: 7693 - protein, 117 aa, Brassica napus
  misc_feature (1)..(117): useful for making plants with modified plant phenotypes as described in USSN 12/139,269
  misc_feature (1)..(117): Public GI no. 30725332
  misc_feature (1)..(117): Utility: Useful for making smaller plants
MLSCNIKGVVNKFPLRIEAEKVTVKEVDFNPDFLRYMFAKIDWKALVDGARSMEYTELPDNAPDTTTLESDETFLRKFHHALLELHLEEGSLVCPETGRKFSVSKGIPNMLLHEDEV

SEQ ID NO: 7694 - protein, 115 aa, Glycine max
  misc_feature (1)..(115): useful for making plants with modified plant phenotypes as described in USSN 12/139,269
  misc_feature (1)..(115): Ceres CLONE ID no. 709877
  misc_feature (1)..(115): Utility: Useful for making smaller plants
  misc_feature (102)..(102): Xaa is any aa, unknown or other
  misc_feature (113)..(113): Xaa is any aa, unknown or other
  misc_feature (114)..(114): Xaa is any aa, unknown or other
MLSSNIKGVVNGFPLRIEAEKVVEKTVEMNGEFLKKMFEKIDWKAFVDASRAMGYTELPEEADSSMLDSDEFLNRFHHALLELHLEEGVLVCPETGRRFPVXKGIPNMLLHEXXV

SEQ ID NO: 7695 - protein, 115 aa, Glycine max
  misc_feature (1)..(115): useful for making plants with modified plant phenotypes as described in USSN 12/139,269
  misc_feature (1)..(115): Ceres CLONE ID no. 479137
  misc_feature (1)..(115): Utility: Useful for making smaller plants
MLSSNIKGVVNGFPLRIEAEKVMEKTMEMNSEFLEKMFEKVDWKAFVDASRAMGYTELPEEANSSMLDSDEFLNRFHHALLELDLEEGALVCPETGRRFPVSKGIPNMLLHEDEV

SEQ ID NO: 7696 - DNA, 1087 bp, Arabidopsis thaliana
  misc_feature (1)..(1087): useful for making plants with modified plant phenotypes as described in USSN 12/139,269
  misc_feature (1)..(1087): Ceres CLONE ID no. 14033
  misc_feature (1)..(1087): Also known as  Ceres CDNA ID no. 23370457
attagctcttcactgaaatctcataaaccctaaatccccaaaatggaataatcaaaatttcatcaggagatctctaaaatcgaaatctacttgatcccgcaacgaagaaatgttaagaagaagactcttgtcgatcatatcaacatcactcatcaattcttcgtttcatcaaaccgcgaaacccagattcatcatttcttcaccacttcttcaatgccgtccttctccgatctctactcaaattccgacctctacgagcagggctttgtcgtttcaaggaatcagggcttatagtttattgagcttgaacgatctgagagacaatgtgccgagaaaactcaagacgaggaaaggaagaggtattgggtctggtaaaggtaaaactgctggaagaggtcacaaggggcaaaaagcgagaggaacgatgaagtttggtttcgaaggtggtcagactccactacgacgtcgtttacccaaacgtggcttcaagaacaaatttaagctccattttcagccggttggtctagggaagattgctaaactcataaacgctgggaagatagattctcatgaattgattacaatgaaaacgctcaaggatgtgggagccataggaaagcaaatagaagatggagtaagactaatgggtcgtggtgctgatgatatcaaatggccacttcatttcgaggtttcgagagtgacggttagggccaaagaggtggtggaagcagcaggaggatcagtgagaagagtgtattacaacaagttgggcttaagggcattgcttaaaccggaatggtttgagaagaaaggaaggttattgccaaaagcagcgcgaccacctcctaaacaacaagataaggttgatagcattggacgtcttccagctccgaaaaaacccattcccttctttgcagctgaggagaccaaagttgaatctcctgttgaatcataattttgggctgccatttaacgtttgatgtttctgtttaagttgtttgtgttgtttcttggtcaatgttcaccactagaaaattgagaatgtcggattttaatttgacaaataaggtctttctcgttttacttt

SEQ ID NO: 7697 - protein, 281 aa, Arabidopsis thaliana
  misc_feature (1)..(281): useful for making plants with modified plant phenotypes as described in USSN 12/139,269
  misc_feature (64)..(162): Pfam Name: Ribosomal_L15; Pfam Description: Ribosomal protein L15 amino terminal region
  misc_feature (64)..(162): Pfam Name: Ribosomal_L15; Pfam Description: Ribosomal protein L15 amino terminal region
  misc_feature (1)..(281): Utility: Useful for making smaller plants
MLRRRLLSIISTSLINSSFHQTAKPRFIISSPLLQCRPSPISTQIPTSTSRALSFQGIRAYSLLSLNDLRDNVPRKLKTRKGRGIGSGKGKTAGRGHKGQKARGTMKFGFEGGQTPLRRRLPKRGFKNKFKLHFQPVGLGKIAKLINAGKIDSHELITMKTLKDVGAIGKQIEDGVRLMGRGADDIKWPLHFEVSRVTVRAKEVVEAAGGSVRRVYYNKLGLRALLKPEWFEKKGRLLPKAARPPPKQQDKVDSIGRLPAPKKPIPFFAAEETKVESPVES

SEQ ID NO: 7698 - protein, 295 aa, Arabidopsis thaliana
  misc_feature (1)..(295): useful for making plants with modified plant phenotypes as described in USSN 12/139,269
  misc_feature (1)..(295): Public GI no. 50508079
  misc_feature (1)..(295): Utility: Useful for making smaller plants
MWRRASHLLRATATATATAVSRRVPHPHPAPATAISTVLPAPKLASSLSYATQAAAAAAVPAARAPRTVGSLLRLNDLRDNPGARKQKTRKGRGIGSGKGKTAGRGHKGQKARGTARFGFEGGQTPLRRRLPRRGFKNRFSLTFQPCGLGKIAKLINAGKIDSSELITMKTLKDTGAIGKQIKDGIRLMGRGAEEIKWPIHLEVSRTTARAKAAVEAAGGTVRLVYYNNLGFRALLKPEWFAKKGRLLPKAARPPPKQRDKVDSIGRLPAPTKPLPFTPEELEFAAKREAARVIA

SEQ ID NO: 7699 - DNA, 775 bp, Arabidopsis thaliana
  misc_feature (1)..(775): useful for making plants with modified plant phenotypes as described in USSN 12/139,269
  misc_feature (1)..(775): Ceres CLONE ID no. 28528
  misc_feature (1)..(775): Also known as  Ceres CDNA ID no. 23646383
atagatacaagtgattgctatacatataacaaacacaagaaaacaccaaaagaccacatatccttccaatggccccccttcaacgcaccatctcggatatttcacaccaaatttcaatagacaacactctaacaaaagaaccatctccaaccgcaaccgcaacaactttgttatccttatcagcgatatccgaagtggaagatgcaaagtgtgagtgttgtggcatgtctgaagagtgcacgccggagtacatacaccgtgtgcgttcaaaattctcagggaagctgatttgcgggctgtgcgaaaaagcggtggagggggagatggagaagatgaacaacagtgaagtgctgatggagaagcggcgagaagaggcagtgaaggtacacatgagcgcatgttcccggttcaacaggctaggccggagttatccagtgttgtaccaagcagaagcggttaaggaaatgctgaaaaagaggtctaagaagatggttgtagccaccaagcctgaaaaaggtggcctcgctaggagctctagctgcatgccggctttagctaaggagcttaaagatcgtaccttggttaattagcttatttgtatactcacgtacacgtatgttatgttcatatatagatttgaatttacatgcagacggagatgtgtattaagtgagttatatatgtagttaaaaactgatggaagttttacgtgtgtaaattgtaatgtataatattttttcgtcaagtttattatcaatcaaacgtccgttttctc

SEQ ID NO: 7700 - protein, 173 aa, Arabidopsis thaliana
  misc_feature (1)..(173): useful for making plants with modified plant phenotypes as described in USSN 12/139,269
  misc_feature (43)..(159): Pfam Name: DUF1677; Pfam Description: Protein of unknown function (DUF1677)
  misc_feature (1)..(173): Utility: Useful for making smaller plants
  misc_feature (1)..(173): Utility: Useful for modifying fruit shape, composition and seed yield
MAPLQRTISDISHQISIDNTLTKEPSPTATATTLLSLSAISEVEDAKCECCGMSEECTPEYIHRVRSKFSGKLICGLCEKAVEGEMEKMNNSEVLMEKRREEAVKVHMSACSRFNRLGRSYPVLYQAEAVKEMLKKRSKKMVVATKPEKGGLARSSSCMPALAKELKDRTLVN

SEQ ID NO: 7701 - DNA, 521 bp, Arabidopsis thaliana
  misc_feature (1)..(521): useful for making plants with modified plant phenotypes as described in USSN 12/139,269
  misc_feature (1)..(521): Ceres CLONE ID no. 29009
  misc_feature (1)..(521): Also known as  Ceres CDNA ID no. 23383208
acttaaaccgaacagatttgtcacgaagaagaaatcagtgtagcaaacaccatccatccctgagcaaagatagaagaaaagctatgactgatttgcaaatggaggtagaggtagataccaattcttctttgcaggagtctctcccgaagccgcaagtcatgtacagatgtaagaaatgtagaaggatagttgctattgaggaaaacatagtcccgcatgaaccaggaaagggtgaagaatgctttgcttggaaaaagagaagtggaaactctgaacaagtgcaatgctcttccatctttgtcgagcctatgaaatggatgcagacaatacatgatggagtggtggaagagaagcttctatgttttggatgtaacgggagattaggttatttcaactgggctgggatgcaatgtagctgtggtgcatgggttaatccggcttttcagcttaataaaagccgaatagacgagtgtaaatccgagccaaacccgaacctgaatatggaaacttgatgaaaaagg

SEQ ID NO: 7702 - protein, 142 aa, Arabidopsis thaliana
  misc_feature (1)..(142): useful for making plants with modified plant phenotypes as described in USSN 12/139,269
  misc_feature (1)..(142): Utility: Useful for making smaller plants
MTDLQMEVEVDTNSSLQESLPKPQVMYRCKKCRRIVAIEENIVPHEPGKGEECFAWKKRSGNSEQVQCSSIFVEPMKWMQTIHDGVVEEKLLCFGCNGRLGYFNWAGMQCSCGAWVNPAFQLNKSRIDECKSEPNPNLNMET

SEQ ID NO: 7703 - protein, 137 aa, Zea mays
  misc_feature (1)..(137): useful for making plants with modified plant phenotypes as described in USSN 12/139,269
  misc_feature (1)..(137): Ceres CLONE ID no. 300070
  misc_feature (1)..(137): Utility: Useful for making smaller plants
MFEDDPGLSLESGSCQDSSKVEQRKTAYRCRKCRRVIAVEGNVISHVPGEGESCFDWNRRKSGHPYNNKEHGCSSLFVEPLKWMTPVEDGALEGKLSCIHCGARLGYFNWSGIQCNCGSWVTPAFQIVKSKVDISTI

SEQ ID NO: 7704 - DNA, 1696 bp, Arabidopsis thaliana
  misc_feature (1)..(1696): useful for making plants with modified plant phenotypes as described in USSN 12/139,269
  misc_feature (1)..(1696): Ceres CLONE ID no. 32574
  misc_feature (1)..(1696): Also known as  Ceres CDNA ID no. 23377569
atcctgagaatggtcacaaattctctacctctctctctctctctctctggtagagaaaatggagatatcagttgcatcggtaacagtttctgtagctgtagttgttgtgtcatggtgggtatggagaactttacagtgggtttggcttaaaccaaagatgcttgagagttacctgagaagacaaggtcttgccggaactccttacacgcctcttgtcggtgatttgaagagaaattttagcatgctggctgaggcaagatccaaacccatcaacctaacagatgatatcacaccacgtatcgtgccttatccgttgcaaatgctcaagactcatgggaggactttctttacatggtttggacccataccaacaatcaccataatggatcctgagcaaatcaaagaagtgttcaacaaagtttatgatttccagaaggcacatacgtttcctctgggcagattaatagcggctggactcgttagttatgatggtgataaatggacaaaacaccgaagaatcatcaacccggctttccaccttgagaagatcaaaaatatggtacctgcgttccaccagagctgcagcgagattgttggcgaatgggacaagttagtgacggataaacagtcatcctgtgaggtggatatttggccttggcttgtgagtatgactgcagatgtgatctcccgtactgcatttggcagcagctacaaagaagggcagaggatatttgagctccaagcggaattagcacagctcatcattcaagcttttcggaaagctattatccctggatatcgttatcttcctacaaagggtaatagaaggatgaaagcagcagctagagaaatcaaatttatactgagagggatcgttaacaaaaggcttagggcaagagacctggggaagcaccaagtgacgatttgctgggtatacttcttgaatcgaatttgggacaaacaaaaggaaatggaatgagtaccgaggaactgatggaggagtgcaagttgttctatttcgctgggcaagagactactacagtacttctggtttggacaatggtgttgttaagccaacaccaagattggcaggctcgtgcaagagaagaagtgaagcaagtttttggcgataaagaacctgatgcagaaggcttgaaccagctcaaagttgtaagtaaaccgaaccaaaaaccttcaagtgacgtgagttctttcgttgcattgaagctgaaagatttgatccctcacagatgacgatgatattatatgaagtccttaggctatatcctccagtagtccagctgacccgagccattcacaaagagatgcagctaggtgacctgacactaccaggcggcgttcagataagtctaccaattctgctaatccaacgcgacagggagctgtggggaaacgatgcaggggagttcaagccagatagattcaaagacggtctctcaaaggcaacaaagaaccaagtctccttctttccttttgcgtggggaccgaggatctgcattggccaaaattttgcactgcttgaggcaaagatggcaatgacactgattctacggaaattctcctttgagctttctccttcttatgtttcacgcgccttacacagtcctcactactcacccacagttcggtgctcctctcatcttgcacaagctctaatcgtataaaccccttgttc

SEQ ID NO: 7705 - protein, 306 aa, Arabidopsis thaliana
  misc_feature (1)..(306): useful for making plants with modified plant phenotypes as described in USSN 12/139,269
  misc_feature (90)..(285): Pfam Name: p450; Pfam Description: Cytochrome P450
  misc_feature (90)..(285): Pfam Name: p450; Pfam Description: Cytochrome P450
  misc_feature (1)..(306): Utility: Useful for making smaller plants
MEISVASVTVSVAVVVVSWWVWRTLQWVWLKPKMLESYLRRQGLAGTPYTPLVGDLKRNFSMLAEARSKPINLTDDITPRIVPYPLQMLKTHGRTFFTWFGPIPTITIMDPEQIKEVFNKVYDFQKAHTFPLGRLIAAGLVSYDGDKWTKHRRIINPAFHLEKIKNMVPAFHQSCSEIVGEWDKLVTDKQSSCEVDIWPWLVSMTADVISRTAFGSSYKEGQRIFELQAELAQLIIQAFRKAIIPGYRYLPTKGNRRMKAAAREIKFILRGIVNKRLRARDLGKHQVTICWVYFLNRIWDKQKEME

SEQ ID NO: 7706 - protein, 512 aa, Arabidopsis thaliana
  misc_feature (1)..(512): useful for making plants with modified plant phenotypes as described in USSN 12/139,269
  misc_feature (1)..(512): Ceres CLONE ID no. 1012695
  misc_feature (1)..(512): Utility: Useful for making smaller plants
MEISVASVTISVVLAVVSWWIWRTLQWVWFKPKMLEHYLRRQGLAGTPYTPLVGDLKKNFSMLSEARSKPLKLTDDISPRVVPYPLQMFKTYGRTYFTWFGPIPTITIMDPEQIKEVFNKVYDFQKPHTFPLATIIAKGLANYDGDKWAKHRRIINPAFHIEKIKNMVPAFHQSCREVVGEWDQLVSDKGSSCEVDVWPGLVSMTADVISRTAFGSSYKEGQRIFELQAELAQLIIQAFRKAFIPGYSYLPTKSNRRMKAAAREIQVILRGIVNKRLRAREAGEAPSDDLLGILLESNLRQTEGNGMSTEDLMEECKLFYFAGQETTSVLLVWTMVLLSQHQDWQARAREEVKQVFGDKEPDAEGLNQLKVMTMILYEVLRLYPPVTQLTRAIHKELKLGDLTLPGGVQISLPILLVQHDIELWGNDAAEFNPDRFKDGLSKATKSQVSFFPFAWGPRICIGQNFALLEAKMAMALILRRFSFEISPSYVHAPYTVITIHPQFGAQLIMHKL

SEQ ID NO: 7707 - protein, 527 aa, Zea mays
  misc_feature (1)..(527): useful for making plants with modified plant phenotypes as described in USSN 12/139,269
  misc_feature (1)..(527): Ceres CLONE ID no. 1573884
  misc_feature (1)..(527): Utility: Useful for making smaller plants
MATCVLLMLREVSPWALASVVASVSLLWLVVWTLEWAWWTPWRLERALRVQGLKGTRYRLFTGDLRETARANREARKKPLPLGSHDIAPRVQPMHHSTIKEYGKLSFTWFGPTPRVMIPDPELVKEVLSNKFGHFGKPRSNRIGRLLANGLVNHDGEKWAKHRRILNPAFHHEKIKGMMPVFSTCCIEMITRWDNSMPSEGSSEIDVWPEFQNLTGDVISRTAFGSNYQEGRRIFELQGELAERLIQSVQTIFIPGYWFLPTKNNRRMRAIDVEIRKILREIIGKREKDTKNRETNNDDLLGLLLESNTRQSNGNASLGLTTEDVIEECKLFYFAGMETTSVLLTWTLIVLSMHPEWQERAREEVLSHFGRTTPDYDSLSRLKTITMILHEVLRLYPPATFLTRRTYKEMELGGIKYPAGVDLLLPVIFIHHDPDIWGKDASEFNPERFANGISSATRHQAAFFPFGGGPRICIGQSFALLEAKMTLCTILQRFSFELSPSYTHAPYTVITLHPQHGAQIRLKKLSP

SEQ ID NO: 7708 - protein, 523 aa, Glycine max
  misc_feature (1)..(523): useful for making plants with modified plant phenotypes as described in USSN 12/139,269
  misc_feature (1)..(523): Ceres CLONE ID no. 479101
  misc_feature (1)..(523): Utility: Useful for making smaller plants
MEAPWATTSSSIVFVIVILALTSWAWRMLNWLWIRPKRLERLLREQGLQGNPYRILVGDLKEIVKLQMEARSKPMNLSHDIVPRVFAHLHQSVLKHGKNSFIWFGPKPRVTLTDPELIKDVLNKISDFRKPEANPLAKLLATGLVNYDGEKWNKHRRLINPAFSLEKLKIMLPIFFKSCNDLIIKWEGMLSYDGSCEMDVWPFLQNLASDVIARTAFGSSFEEGKRIFQLQKELAELTMKVIMKVYIPGWRFVPTATNRRMKEIDRYIKASLTDMIKKREKAPKTGEATRDDLLGILLESNHKEIQEHRNNENVGMNLNDVIEECKLFYFAGQETTSVLLVWTMVLLSRYPDWQSRAREEVLQVFGKQAPNFDGLSHLKIVTMILYEVLRLYPPGIGLTRSVHRDMKLGNLTLPAGVQVSLPIIMVHHDRELWGDDAKEFNPERFSEGVSKATNGRVSFFPFGWGPRICIGQNFSLLEAKMALSMILQHFSFELSPAYTHAPFTVITLQPQYGAHVILRKVEM

SEQ ID NO: 7709 - protein, 502 aa, Glycine max
  misc_feature (1)..(502): useful for making plants with modified plant phenotypes as described in USSN 12/139,269
  misc_feature (1)..(502): Ceres CLONE ID no. 546712
  misc_feature (1)..(502): Utility: Useful for making smaller plants
MLILILALIWVWKKFNSLWLTPKRLEKILREQGLRGSPYRFKVGDTKETLKMQMQAMSKPMNLFSNDIGPRVSPYDHYIVNKHGKNSFIWNGQTPRVTLTDPELIKDVFNKIYDFGKPNMGPNIRSLIPGLAMHEGEKWSKHRKIINPAFNLEKLKNMLPLFIQCCDDLISKWEEMLSSDGSSEIDVWPFVKNLTADVISRTAFGSSYLEGRRIFQLLKEKIELTLKMRGQRLVPKRMKEIDRDIKASLMDIINKRDKALKAGEATKNNLLDILLESNHKEIEEHGNNKNVGMNIEEVIEECKLFYFAGQDTTSVLLVWTMILLSRYPDWQARAREEVSQVFGNQKPTFDGLNQLKIVTMILYEVLRLYPPGVGVPRKVIKDVKLGNLSFPAGVEIFISTILVHHDSELWGDDAKEFKPERFSEGVLKATNGRFSFFPFGGGPRICIAQNFALLEAKIALSMILQCFSFELSPTYTHAPTMVMTIQPQYGAPVILHKVEKYE

SEQ ID NO: 7710 - DNA, 447 bp, Arabidopsis thaliana
  misc_feature (1)..(447): useful for making plants with modified plant phenotypes as described in USSN 12/139,269
  misc_feature (1)..(447): Ceres CLONE ID no. 32612
  misc_feature (1)..(447): Also known as  Ceres CDNA ID no. 23557580
aaaaactcgtcttcaagctgtctatattttctccggcgagcggtgctgataacttcgtagctccgaaacgccgccatggccgcagaatttgatggaaaaatcgaaagcaaagggctaaacccgggactgatcgtccttcttgtaataggagggttgctactgacattccttgtaggaaacttcatcctttacacatacgcacagaagaatttacctccgaggaagaagaaacccgtttctaagaagaagatgaagaaagagaagatgaagcaaggcgtccaagttcctggcgagtagcttttgttatatgttgtcgggattatcctttgatgataactcactctgctggactagaacttgtatgactccgttactctttagttttttgatgttttcgatgtagcatgcatgatattttcttgagttgacaatctataagctttactg

SEQ ID NO: 7711 - protein, 73 aa, Arabidopsis thaliana
  misc_feature (1)..(73): useful for making plants with modified plant phenotypes as described in USSN 12/139,269
  misc_feature (4)..(73): Pfam Name: S1FA; Pfam Description: DNA binding protein S1FA
  misc_feature (1)..(73): Utility: Useful for making smaller plants
MAAEFDGKIESKGLNPGLIVLLVIGGLLLTFLVGNFILYTYAQKNLPPRKKKPVSKKKMKKEKMKQGVQVPGE

SEQ ID NO: 7712 - protein, 73 aa, Brassica napus
  misc_feature (1)..(73): useful for making plants with modified plant phenotypes as described in USSN 12/139,269
  misc_feature (1)..(73): Ceres CLONE ID no. 1068098
  misc_feature (1)..(73): Utility: Useful for making smaller plants
MADEFSGKIESKGLNPGLIVLLVIGGLLVTFLVGNFILYTYAQKNLPPRKKKPVSKKKMKKEKLKQGVQVPGE

SEQ ID NO: 7713 - protein, 70 aa, Brassica napus
  misc_feature (1)..(70): useful for making plants with modified plant phenotypes as described in USSN 12/139,269
  misc_feature (1)..(70): Public GI no. 498705
  misc_feature (1)..(70): Utility: Useful for making smaller plants
MAVNEVEAKGLNPGLIVLLVIGGLLLTFLVGNFILYTYAQKNLPPKKKKPISKKKMKRERLKQGVAPPGE

SEQ ID NO: 7714 - protein, 82 aa, Glycine max
  misc_feature (1)..(82): useful for making plants with modified plant phenotypes as described in USSN 12/139,269
  misc_feature (1)..(82): Ceres CLONE ID no. 563046
  misc_feature (1)..(82): Utility: Useful for making smaller plants
MADDFEFADKVPPSFDRAGSKGFNPALIVLLLVGGLLLTFLIGNYVLYTYAQKTLPPRKKKPVSKKKMKKERLKQGVSAPGE

SEQ ID NO: 7715 - protein, 82 aa, Triticum aestivum
  misc_feature (1)..(82): useful for making plants with modified plant phenotypes as described in USSN 12/139,269
  misc_feature (1)..(82): Ceres CLONE ID no. 737633
  misc_feature (1)..(82): Utility: Useful for making smaller plants
MADDFEFSDKVPPSFDRVGSKGFNPALIVLLLVGGLLLIFLVGNYVLYTYAQKTLPPRKKKPISKKKMKKERLKQGVSAPGE

SEQ ID NO: 7716 - protein, 82 aa, Glycine max; identical to SEQ ID NO: 7715
  misc_feature (1)..(82): useful for making plants with modified plant phenotypes as described in USSN 12/139,269
  misc_feature (1)..(82): Ceres CLONE ID no. 1607819
  misc_feature (1)..(82): Utility: Useful for making smaller plants

SEQ ID NO: 7717 - protein, 83 aa, Parthenium argentatum
  misc_feature (1)..(83): useful for making plants with modified plant phenotypes as described in USSN 12/139,269
  misc_feature (1)..(83): Ceres CLONE ID no. 1608024
  misc_feature (1)..(83): Utility: Useful for making smaller plants
MDYESDPSFDKSQFVNKNVEATGFNPGLIVLLVVGGLLITFLVGNYVLYMYAQKTLPPRKKKPVSKKKLKREKLKQGVAVPGE

SEQ ID NO: 7718 - protein, 80 aa, Parthenium argentatum
  misc_feature (1)..(80): useful for making plants with modified plant phenotypes as described in USSN 12/139,269
  misc_feature (1)..(80): Public GI no. 38347601
  misc_feature (1)..(80): Utility: Useful for making smaller plants
MADQFADSANNVVIEEVNKGLNPGMIVLIVVATFLLLFFVGNYALYVYAQKTLPPRKKKPVSKKKMKREKLKQGVSAPGE

SEQ ID NO: 7719 - protein, 76 aa, Parthenium argentatum
  misc_feature (1)..(76): useful for making plants with modified plant phenotypes as described in USSN 12/139,269
  misc_feature (1)..(76): Public GI no. 38347600
  misc_feature (1)..(76): Utility: Useful for making smaller plants
MADQSNNMIIEEVNKGLNPGTIVLLVVATLLILFFVGNYALYMYAQKTLPPRKKKPVSKKKLKREKLKQGVSAPGE

SEQ ID NO: 7720 - protein, 63 aa, Parthenium argentatum
  misc_feature (1)..(63): useful for making plants with modified plant phenotypes as described in USSN 12/139,269
  misc_feature (1)..(63): Public GI no. 1173349
  misc_feature (1)..(63): Utility: Useful for making smaller plants
  misc_feature (11)..(11): Xaa is any aa, unknown or other
  misc_feature (30)..(30): Xaa is any aa, unknown or other
NKGLNPGMVVXLVVASFLLIFFVGNYALYXYAQKTLPPKKKKPVSKKKLKKEKLKQGVSAPGE

SEQ ID NO: 7721 - protein, 56 aa, Zea mays
  misc_feature (1)..(56): useful for making plants with modified plant phenotypes as described in USSN 12/139,269
  misc_feature (1)..(56): Ceres CLONE ID no. 273675
  misc_feature (1)..(56): Utility: Useful for making smaller plants
MVVLLVVASFLLIFFVGNYALYVYAQKTLPPKKKKPVSKKKLKKEKLKQGVSAPGE

SEQ ID NO: 7722 - protein, 80 aa, Zea mays
  misc_feature (1)..(80): useful for making plants with modified plant phenotypes as described in USSN 12/139,269
  misc_feature (1)..(80): Ceres CLONE ID no. 289176
  misc_feature (1)..(80): Utility: Useful for making smaller plants
  misc_feature (3)..(3): Xaa is any aa, unknown or other
  misc_feature (44)..(44): Xaa is any aa, unknown or other
MAXQFADSANNVIIEEVNKGLNPGMVVLLVVASFLLLFFAGNYXLYVYAQKTLPPKKKKPVSKKKLKREKLKQGVSAPGE

SEQ ID NO: 7723 - protein, 80 aa, Zea mays
  misc_feature (1)..(80): useful for making plants with modified plant phenotypes as described in USSN 12/139,269
  misc_feature (1)..(80): Ceres CLONE ID no. 984214
  misc_feature (1)..(80): Utility: Useful for making smaller plants
MADQFADSANNVIIEEVNKGLNPGMVVLLVVASFLLLFFAGNYALYVYAQKTLPPKKKKPVSKKKLKREKLKQGVSAPGE

SEQ ID NO: 7724 - protein, 80 aa, Zea mays; identical to SEQ ID NO: 7723
  misc_feature (1)..(80): useful for making plants with modified plant phenotypes as described in USSN 12/139,269
  misc_feature (1)..(80): Ceres CLONE ID no. 1444070
  misc_feature (1)..(80): Utility: Useful for making smaller plants

SEQ ID NO: 7725 - protein, 56 aa, Zea mays
  misc_feature (1)..(56): useful for making plants with modified plant phenotypes as described in USSN 12/139,269
  misc_feature (1)..(56): Ceres CLONE ID no. 219485
  misc_feature (1)..(56): Utility: Useful for making smaller plants
MVVLLVVASFLLLFFAGNYALYVYAQKTLPPKKKKPVSKKKLKREKLKQGVSAPGE

SEQ ID NO: 7726 - DNA, 1133 bp, Arabidopsis thaliana
  misc_feature (1)..(1133): useful for making plants with modified plant phenotypes as described in USSN 12/139,269
  misc_feature (1)..(1133): Ceres CLONE ID no. 36094
  misc_feature (1)..(1133): Also known as  Ceres CDNA ID no. 23359771
atttttaatagactatcaaaaaaacaatctcatttcatttgctctcttctccgagaaaatggcgtttggtttgatcggaagagttgttggaacgaaaccgtcacgattatccacggcggcgcgattgattccggcgcgatggacatcaaaaggatcagaagcacaatcgaaagcttcaaccggcggcggaggagcgagtctgaagacgtttcagatctatcgatggaatccagataatcctggaaagccagagcttcaagattacaaaatcgatctcaaggattgtggtccaatggttctagatgctttgattaagattaagaacgagatggatccatcgctcactttccgtcgctcttgccgtgaaggtatttgtggttcgtgtgctatgaacattgatggatgtaatggtcttgcttgtttaacgaagattgaatctggatctaaagagacgacgattacgccgttgccgcatatgtttgtgattaaggatttggttgtggatatgacgaatttttataatcagtataagagtattgagccgtggttgaagaggaagaatccagcatctgttcctgggaaagagattttacagagtaagaaagatagagctaagcttgatggaatgtatgaatgtattctctgtgcttgttgtagcacgtcttgccctagctattggtggaaccctgagtcttatcttggtccagctgctttgcttcatgccaacaggtggataagtgatagccgagatgagtacactaaggaaagacttgaagccattgacgatgagttcaaactgtatcgatgccacacaattctgaactgtgctcgtgcctgtccaaagggattgaacccagggaaacagatcacacacatcaagcagcttcagaaatctggttgaacaacaaatgaatcaggcagtacctaatggatttttgattctaataatctgcaagaaactccaattttggattcattcttgtattgctgtcacaactatcagaattagattattttgtggtatatcttgatgaattttttttgcctacaacaagcaataaaactctgctttttttatcatccactcattcagctttgccttaatacaaacatttggatttcgagttttgctc

SEQ ID NO: 7727 - protein, 280 aa, Arabidopsis thaliana
  misc_feature (1)..(280): useful for making plants with modified plant phenotypes as described in USSN 12/139,269
  misc_feature (1)..(280): Utility: Useful for making smaller plants
MAFGLIGRVVGTKPSRLSTAARLIPARWTSKGSEAQSKASTGGGGASLKTFQIYRWNPDNPGKPELQDYKIDLKDCGPMVLDALIKIKNEMDPSLTFRRSCREGICGSCAMNIDGCNGLACLTKIESGSKETTITPLPHMFVIKDLVVDMTNFYNQYKSIEPWLKRKNPASVPGKEILQSKKDRAKLDGMYECILCACCSTSCPSYWWNPESYLGPAALLHANRWISDSRDEYTKERLEAIDDEFKLYRCHTILNCARACPKGLNPGKQITHIKQLQKSG

SEQ ID NO: 7728 - protein, 279 aa, Arabidopsis thaliana
  misc_feature (1)..(279): useful for making plants with modified plant phenotypes as described in USSN 12/139,269
  misc_feature (1)..(279): Ceres CLONE ID no. 14357
  misc_feature (1)..(279): Utility: Useful for making smaller plants
MASGLIGRLVGTKPSKLATVARLIPVRWTSTGAEAETKASSGGGRGSNLKTFQIYRWNPDNPGKPELQNYQIDLKDCGPMVLDALIKIKNEMDPSLTFRRSCREGICGSCAMNIDGCNGLACLTKIQDEASETTITPLPHMFVIKDLVVDMTNFYNQYKSIEPWLKRKTPASVPAKEILQSKKDRAKLDGMYECILCACCSTSCPSYWWNPESYLGPAALLHANRWISDSRDEYTKERLEAIDDEFKLYRCHTILNCARACPKGLNPGKQITHIKQLQR

SEQ ID NO: 7729 - protein, 282 aa, Zea mays
  misc_feature (1)..(282): useful for making plants with modified plant phenotypes as described in USSN 12/139,269
  misc_feature (1)..(282): Ceres CLONE ID no. 265075
  misc_feature (1)..(282): Utility: Useful for making smaller plants
MAAALLRRSPAARALLSPALSSRLVASKPHSSSPAPPPPAKADSSTKTFSIYRWDPDSPSTKPHLKDYQVDLSDCGPMVLDALLKIKNEQDPSLTFRRSCREGICGSCAMNIDGDNGLACLTKISGASSASTVSPLPHMFVVKDLVVDMTNFYSQYKSVEPWLKRKDQPPQQGKEIPQTKADRAKLDGMYECILCACCSTSCPSYWWNPEEYLGPAALLHANRWIQDSRDQFTKERLDAINDEFKLYRCHTIKNCTHACPKGLNPAKQIDTIKKLQLGAPSA

SEQ ID NO: 7730 - protein, 279 aa, Zea mays
  misc_feature (1)..(279): useful for making plants with modified plant phenotypes as described in USSN 12/139,269
  misc_feature (1)..(279): Ceres CLONE ID no. 1000303
  misc_feature (1)..(279): Utility: Useful for making smaller plants
MAAALLRRSPAVRALLSPALSSRLVASKPHSSSPAPPPPAKAASSTKTFSIYRWDPDSPSTKPHLKDYQVDLSDCGPMVLDALLKIKNEQDPSLTFRRSCREGICGSCAMNIDGDNGLACLTKISAASSASTVSPLPHMFVIKDLVVDMTNFYNQYKSVEPWLKRKDPPPQLGKEVPQTKADRAKLDGMYECILCACCSTSCPSYWWNPEEYLGPAALLHANRWIQDSRDQFTKERLDAINDEFKLYRCHTIKNCTHACPKGLNPAKQIDTIKKLQLDA

SEQ ID NO: 7731 - DNA, 390 bp, Arabidopsis thaliana
  misc_feature (1)..(390): useful for making plants with modified plant phenotypes as described in USSN 12/139,269
  misc_feature (1)..(390): Ceres CLONE ID no. 97031
  misc_feature (1)..(390): Also known as  Ceres CDNA ID no. 13607442
aaagcctcatcctcatactcactaagttttagaccaatcttgattcgtagattttatttttggaagatgtacggtgtcggtggatcgagcacagcgggtttcgcagaagcttacgcgatgaggaagatttataaagaaaagatgaagatgaagcttgcagaggcaaaagtagaggaagaaaaagaaaatgttggaggtaagagtaaaatctggaaaacgaagaaatctaagaagaccctccatactaatccaagggtttcctctgcagatatttaaacatctatatgtatatggttatgtattttttttttttcttaactttttatgattggttcattttgttcttttgtgtaatattttttttacagttaataacaaagaattatattg

SEQ ID NO: 7732 - protein, 69 aa, Arabidopsis thaliana
  misc_feature (1)..(69): useful for making plants with modified plant phenotypes as described in USSN 12/139,269
  misc_feature (1)..(69): Utility: Useful for making smaller plants
MYGVGGSSTAGFAEAYAMRKIYKEKMKMKLAEAKVEEEKENVGGKSKIWKTKKSKKTLHTNPRVSSADI

SEQ ID NO: 7733 - DNA, 653 bp, Arabidopsis thaliana
  misc_feature (1)..(653): useful for making plants with modified plant phenotypes as described in USSN 12/139,269
  misc_feature (1)..(653): Ceres CLONE ID no. 115966
  misc_feature (1)..(653): Also known as  Ceres CDNA ID no. 23385468
atcaatcttacatccaaaacttaaagtattcttacatccaaaaacaaaaaaaatatggcaaagtctcttctcatagtaatgctcatgtctatagtaatgttttacatggctcgtccaattttctcccaaaaaattaatccatatttagaggtgatgccagaagatgtgaccatatctccatcttcagattttgattacgtcgaagctccctatgaagctccattcgaagaagctgattcaccagcaatggaatatgacatggagcttgctcaccattattcggacaaacagttcaagtttcttgaggcttgctctgaaaagccgagttcaaaatgcggaaatgaggttttcaagaacatgttaaatgagacgatgccaattacagaagaatgttgtcgtgatatattgaagatgggcaaagattgccatctaggattggttaaactcatatttgccacatatgagtataaaaatattgcatctaagggcattccaaagagcaaacaaacatggaacgaatgtgtccgtagagtggggagcaagattggtgctccggtctcttttgaacaataaactaatatttccgtgtattgatgtgtctatgcgtttttgtaatttgattattactattataaagcaactgctactatttt

SEQ ID NO: 7734 - protein, 172 aa, Arabidopsis thaliana
  misc_feature (1)..(172): useful for making plants with modified plant phenotypes as described in USSN 12/139,269
  misc_feature (34)..(172): Pfam Name: DUF784; Pfam Description: Arabidopsis thaliana protein of unknown function (DUF784)
  misc_feature (1)..(172): Utility: Useful for making smaller plants
MAKSLLIVMLMSIVMFYMARPIFSQKINPYLEVMPEDVTISPSSDFDYVEAPYEAPFEEADSPAMEYDMELAHHYSDKQFKFLEACSEKPSSKCGNEVFKNMLNETMPITEECCRDILKMGKDCHLGLVKLIFATYEYKNIASKGIPKSKQTWNECVRRVGSKIGAPVSFEQ

SEQ ID NO: 7735 - protein, 172 aa, Arabidopsis thaliana
  misc_feature (1)..(172): useful for making plants with modified plant phenotypes as described in USSN 12/139,269
  misc_feature (1)..(172): Public GI no. 10998140
  misc_feature (1)..(172): Utility: Useful for making smaller plants
MAKSLLIVMLMSIVMFYMARPIFSQKINPYLEVMPKDVTISPSSNFDYVEAPDEAPFEEADSPAMEYDMELAHHYSDKQLKFLEACSEKPSSKCGNEVFKNMLNETMLITEECCRDILKMGKDCHLGLVKLIFATYEYKNIASKGIPKSKQTWNECVHRVGSKIGAPVSFEQ

SEQ ID NO: 7736 - protein, 172 aa, Arabidopsis thaliana
  misc_feature (1)..(172): useful for making plants with modified plant phenotypes as described in USSN 12/139,269
  misc_feature (1)..(172): Public GI no. 25405889
  misc_feature (1)..(172): Utility: Useful for making smaller plants
MAKSLLMVMLVSIVMFYMARPICSQKINPHSQEMPEDVAISPSSDFDYVEAPDEAPFEEADSPAMEYDRELAHHYSDKQLKFLEACSEKPSSKCGNEVFKNMLNETMPITEECCRDILKMGKDCHLGLVKLIFATYEYKNIASKGIPKSKQAWNECIRRVGSKIGAPVSFEQ

SEQ ID NO: 7737 - protein, 156 aa, Arabidopsis thaliana
  misc_feature (1)..(156): useful for making plants with modified plant phenotypes as described in USSN 12/139,269
  misc_feature (1)..(156): Public GI no. 15220229
  misc_feature (1)..(156): Utility: Useful for making smaller plants
MARPIFSQEIDPYSQEVPKDVAISPSSKFDIYVEAPGEAPFEEADSPAMEYDRELAHHYSHKQLDFLEACSEKPSSKCGNEVFKNMLDETVPITDECCRDILKIGKDCHLGLVKLIFATYEYKNKASKGIPKSKQTWNECVFRVGSKIGAPVSFEQ

SEQ ID NO: 7738 - protein, 149 aa, Arabidopsis thaliana
  misc_feature (1)..(149): useful for making plants with modified plant phenotypes as described in USSN 12/139,269
  misc_feature (1)..(149): Public GI no. 18413965
  misc_feature (1)..(149): Utility: Useful for making smaller plants
MAKSLLMVMLVSIVMFYMACPIFSQEIHEDVAISPTPFEEANSPAMEYDMKLPHYSQKQYDFLEACVEKPSSICGGEIFQNVLDATTLVTDKCCRDILKIGKDCHLGLIKIFFSSYEYKNIASIPRNKQTWNDCLRRVGSKIGVPVSSE

SEQ ID NO: 7739 - protein, 149 aa, Arabidopsis thaliana
  misc_feature (1)..(149): useful for making plants with modified plant phenotypes as described in USSN 12/139,269
  misc_feature (1)..(149): Public GI no. 18413969
  misc_feature (1)..(149): Utility: Useful for making smaller plants
MAKSLLMVMLVSIVMFYMACPIFSQEIHEDVAISPTPFEEANSPAMEYDMKLPHYSQKVFDFLETCAEKPSSICGGEIFQNVLDATTLVTDKCCRDILKIGKDCHLGLIKIFFSSYEYKNIASIPRSKQTWNDCFRRVGSKIGVPVSIE

SEQ ID NO: 7740 - protein, 149 aa, Arabidopsis thaliana
  misc_feature (1)..(149): useful for making plants with modified plant phenotypes as described in USSN 12/139,269
  misc_feature (1)..(149): Public GI no. 8953752
  misc_feature (1)..(149): Utility: Useful for making smaller plants
MAKSLLMVMLVSIVMFYMACPILSQEVHEDVVISPTPFEKAISPAMEYEMKLPHYSQKQYDFLEACVEKPSSICGGEIFQNVLDETNLVTDKCCRNILKIGKDCHLGLMKILFSSYEYKNIASIPRSKQTWNDCLRRVGSKIGVPVSFE

SEQ ID NO: 7741 - protein, 148 aa, Arabidopsis thaliana
  misc_feature (1)..(148): useful for making plants with modified plant phenotypes as described in USSN 12/139,269
  misc_feature (1)..(148): Public GI no. 7267642
  misc_feature (1)..(148): Utility: Useful for making smaller plants
MFDPTYIEHLYHNIPSECWLVAENEIHEDVAISPTPFEEANSPAMEYDKKLPHYSQKVFDFLETCAEKPSSICGGEIFQNVLDATTLVTDKCCRDILKIGKDCHLGLIKIFFSSYEYKNIASIPRSKQTWNDCFRRVGSKIGVPVSIE

SEQ ID NO: 7742 - protein, 169 aa, Arabidopsis thaliana
  misc_feature (1)..(169): useful for making plants with modified plant phenotypes as described in USSN 12/139,269
  misc_feature (1)..(169): Public GI no. 15220221
  misc_feature (1)..(169): Utility: Useful for making smaller plants
MTKTLLMVTLVSIVMFYMARPIFSQEIDPYSLEVLEDVALSSSSKFNIYVEAPDEALFEEADSPAIEYDKDRYKIPDFIAACAMKQSWICLNVVFENMKDEMMPIINECCREILKMGKDCHFRLVEGWSAMYVYGNSIASKDIPYSKQSWNECVRRVGSKFGAPVSFEQ

SEQ ID NO: 7743 - protein, 151 aa, Arabidopsis thaliana
  misc_feature (1)..(151): useful for making plants with modified plant phenotypes as described in USSN 12/139,269
  misc_feature (1)..(151): Public GI no. 22325451
  misc_feature (1)..(151): Utility: Useful for making smaller plants
MAKSFLMVMLASMVMFYMACPIYSQKNISEDIDIAPTSVEGADLPTTEYEIELAHRLHEDYILACPKKPSSKCDDEIFNNMMDGTTPVTSECCRDILKTGKDCHLALVKIVFSTDGYKSKASRAIPKSKQTWNDCVRRVGMEIGAPVTFEA

SEQ ID NO: 7744 - protein, 157 aa, Arabidopsis thaliana
  misc_feature (1)..(157): useful for making plants with modified plant phenotypes as described in USSN 12/139,269
  misc_feature (1)..(157): Public GI no. 22325449
  misc_feature (1)..(157): Utility: Useful for making smaller plants
MAKSILMAILVSILTFSMVCLICSQKIHHYSKEISEDVDISPTSVEGADSPTTEYEIKLAHRLHEDYILACPKKPSSKCDDEIFQNMLDGTTPVTNECCLDILKTGKDCHLALVKIIFSTDDYKNIASRAIPKSKQTWNDCARRVSKEIGAPISFEQ

SEQ ID NO: 7745 - DNA, 1268 bp, Arabidopsis thaliana
  misc_feature (1)..(1268): useful for making plants with modified plant phenotypes as described in USSN 12/139,269
  misc_feature (1)..(1268): Ceres CLONE ID no. 121021
  misc_feature (1)..(1268): Also known as  Ceres CDNA ID no. 23365088
agaaaaaatgggcaacataaataaaaagtaaaagggctctctctcctttctttcagtttcgacattccccagaatctctcttccctttttgtctccaaccaaaacaaaaccttaatcacctttcttcttcttcaaacagagcacaacagagacgttcgttcccactctgtcttaatctcccctgtttcaattcctaaatcgatggaaaacggtggaacaattccgggtcaagaaatcggatcagggcttcaaaaacccgttaacccagatgggtttgtgacgatcgatgttgaaagtttctctagtgtcatccacaaagacttctcttcttctagtccaagaattactttgcagaggaatgtatcgaggaaagggtctccaagaagcaacaacgagagaaaactccattttgacgcaaatggtaatgacaaggagatctcatttcctcagtccccacttagagggtcaagcacgccggaaaaggctagcaccgtgggccccacagaacatgcaggcacggccacaaccgctgccacagctgtttcagcctcgccgcttcatcagatcaccgttactacggctgccacggccgcaggaaatatgattaccgaccaaaatagagaaagaaggttcggtttttcgaggaaatcgagttttaaacgctctcacacttcttggatgcttgatccgaagaaaatcgtcctcttctttgcaactttgtcaagcatgggatcaatcttgttaatcatattcacactctcgatcagcaagtccaatcccggagatatgcctctagactaatagtaaacacacgaagagcattatatataacgcatatatatcatcgaccgacctaagtttgtggccatagaacatgccacagtctcaccgacctacattttaaggagatgtatcagacagaagaacattacaaaaaatgaagagggtaaggttgtgataatagttttatttcgtatgattttttttaaatgaaaaaaaagaagaagacaacagtaagagagagagaaagtgggaagtgggcacgcacgagatcatatgggagattggaaaagaaagcttaagacaagagtttatgactattgtgacaaagacagagaatcttctcttctgttctttcaaattcttttttctctgttttttctttaaatttatttatcgagtatgtgtttcgattgtcttcaatatgttctctatgtgtacatatcaattgcggtgactggtgagcaattttagtttcgtttggtttt

SEQ ID NO: 7746 - protein, 199 aa, Arabidopsis thaliana
  misc_feature (1)..(199): useful for making plants with modified plant phenotypes as described in USSN 12/139,269
  misc_feature (1)..(199): Utility: Useful for making smaller plants
  misc_feature (1)..(199): Utility: Useful for modifying plant architecture, ie amount of branching
MENGGTIPGQEIGSGLQKPVNPDGFVTIDVESFSSVIHKDFSSSSPRITLQRNVSRKGSPRSNNERKLHFDANGNDKEISFPQSPLRGSSTPEKASTVGPTEHAGTATTAATAVSASPLHQITVTTAATAAGNMITDQNRERRFGFSRKSSFKRSHTSWMLDPKKIVLFFATLSSMGSILLIIFTLSISKSNPGDMPLD

SEQ ID NO: 7747 - protein, 203 aa, Glycine max
  misc_feature (1)..(203): useful for making plants with modified plant phenotypes as described in USSN 12/139,269
  misc_feature (1)..(203): Ceres CLONE ID no. 1121512
  misc_feature (1)..(203): Utility: Useful for making smaller plants
  misc_feature (1)..(203): Utility: Useful for modifying plant architecture, ie amount of branching
  misc_feature (109)..(109): Xaa is any aa, unknown or other
MAEIPKLDLSSSCFDNGEPLDSEQKSQKIFVSDHINAFQYADEKADSFVIDMDAFSSGHNKDATNANSRITLQRSLSRKGSQRLGDWKLNNNATLYDKDTVPAICSPKXTLVGPFTPEKPAGMAVGPMGHSMNPHVHNLTADNIPTESKCSITRRNSFRRPSSWAIDPKRVLLFFATLSSMGTMLLIYFTLTISKQSAEEYGG

SEQ ID NO: 7748 - protein, 192 aa, Glycine max
  misc_feature (1)..(192): useful for making plants with modified plant phenotypes as described in USSN 12/139,269
  misc_feature (1)..(192): Ceres CLONE ID no. 1046846
  misc_feature (1)..(192): Utility: Useful for making smaller plants
  misc_feature (1)..(192): Utility: Useful for modifying plant architecture, ie amount of branching
MGTQRILVSDHINAYQYSAEEADSFVIDMDSFSSGINKDSNNANSRITLQRSLSRKGSQRGGDRKVNGNVTLHDRDTAPTTCSPKAALAGSCTAEKSAVVAVGSTHHSTNTQVHHQITITASNMCTTTTPTTESKCITRRNSFKRSSSWLLDPKRVLLFFATLSSMGTMLLIYFTLTLSKQNADEYGGDWQQ

SEQ ID NO: 7749 - DNA, 523 bp, Arabidopsis thaliana
  misc_feature (1)..(523): useful for making plants with modified plant phenotypes as described in USSN 12/139,269
  misc_feature (1)..(523): Ceres CLONE ID no. 248859
  misc_feature (1)..(523): Also known as  Ceres CDNA ID no. 23371046
atcaaggtaagacacttcgcttcaaatcatttgtgtattacagaaacttctgatcgtcatggaagctacttcacaaccatgtttctctcataactcctcacttcattcgacccgtaagcaaccggcaaacccatggaaaaaacccgtaacgggcttgcctcagaggatgcatcctaaagtttacagagtcgagcctgttaacttcaaggagttagttcagaggctaactggtgcagaagacgttgagcaagaggtacatcaagttgaagctaaaccagtcaagatttctgatgatacaacaacagctaaggataatccgttcgcgtttgatctttcaccttcgtcatctcggttctgggaagctttccctctgcttagtcctgctaatctatcaagatggtagcgagaaagaagctattcttgccaatttttcggcaattcatgaatttgtttcatcagaattagaactgtagtagtaacactttatgatcttatctttaaatacaaaagttactgttacatt

SEQ ID NO: 7750 - protein, 114 aa, Arabidopsis thaliana
  misc_feature (1)..(114): useful for making plants with modified plant phenotypes as described in USSN 12/139,269
  misc_feature (35)..(65): Pfam Name: VQ; Pfam Description: VQ motif
  misc_feature (1)..(114): Utility: Useful for making smaller plants
MEATSQPCFSHNSSLHSTRKQPANPWKKPVTGLPQRMHPKVYRVEPVNFKELVQRLTGAEDVEQEVHQVEAKPVKISDDTTTAKDNPFAFDLSPSSSRFWEAFPLLSPANLSRW

SEQ ID NO: 7751 - protein, 138 aa, Brassica napus
  misc_feature (1)..(138): useful for making plants with modified plant phenotypes as described in USSN 12/139,269
  misc_feature (1)..(138): Ceres CLONE ID no. 1126651
  misc_feature (1)..(138): Utility: Useful for making smaller plants
MEATSQPCFSHNYRRSSENYNSSLHSTRKQPAKPWKRPVTASLQRMHPRVYRVEPVNFKELVQSLTGAPQDHERDQVHQVETKPLLKMQHGLVEVRQPLKIFHETTTQENPVAFDLSPSSSRFWEAFPLLSPANLSRW

SEQ ID NO: 7752 - protein, 133 aa, Glycine max
  misc_feature (1)..(133): useful for making plants with modified plant phenotypes as described in USSN 12/139,269
  misc_feature (1)..(133): Ceres CLONE ID no. 591984
  misc_feature (1)..(133): Utility: Useful for making smaller plants
MEAYYSGSYPASTKPISLLHTVRKVQAKPWKKAAVAPPAPTPIRVYKVDAINFRDLVQQLTGAPEFKPADQEQHQLFPSVAPIAATFVDTPQKPMLSSKDNIAASSTVSSATNWYQGAKSEPLEMNLSSPSSL

SEQ ID NO: 7753 - protein, 118 aa, Triticum aestivum
  misc_feature (1)..(118): useful for making plants with modified plant phenotypes as described in USSN 12/139,269
  misc_feature (1)..(118): Ceres CLONE ID no. 879739
  misc_feature (1)..(118): Utility: Useful for making smaller plants
MDHLLHHGHEMRRPSVPGHEAALRAVQKPPAKPWRAGGGLTPAPTPPKVYRVEPREFRDLVQRLTGAPAAAMARQHQHTHQLQRAPTQPVPVRPGGVEDAAAGGQMYAPWCSFPLMGP

SEQ ID NO: 7754 - DNA, 509 bp, Arabidopsis thaliana
  misc_feature (1)..(509): useful for making plants with modified plant phenotypes as described in USSN 12/139,269
  misc_feature (1)..(509): Ceres CLONE ID no. 266142
  misc_feature (1)..(509): Also known as  Ceres CDNA ID no. 23646375
gataaaccctagaagaagaagaagaagaagaagaagaagaagaagcaaaacctgtggagatcgagatgggaaatgagagcaagagcaatttgggaggaggaggaattagggcaaagatggagcactatgtctacagtggggagaagaagcacgttttggctgggatcgggattatctccatcatcttcggaatcccttggtatctaatgaatcaaggatcaaagcatcgttctcaccaagattacttggaaaaagctgataaagctcgaaaagctcgtctctcatcatcttcatcctcggataagtagtcatctccccccacttggatggagactctagtcaactacattttgtgaatggatccatacatcatcgttttccatgtctataaactcagccatgtctgttctagagtgtggttaagttcagatatgtatctttacactctacacttaggtttctttatcgaagatatgtaaatttgcgataagttaaaggattcatccttt

SEQ ID NO: 7755 - protein, 80 aa, Arabidopsis thaliana
  misc_feature (1)..(80): useful for making plants with modified plant phenotypes as described in USSN 12/139,269
  misc_feature (1)..(80): Utility: Useful for making smaller plants
MGNESKSNLGGGGIRAKMEHYVYSGEKKHVLAGIGIISIIFGIPWYLMNQGSKHRSHQDYLEKADKARKARLSSSSSSDK

SEQ ID NO: 7756 - protein, 88 aa, Brassica napus
  misc_feature (1)..(88): useful for making plants with modified plant phenotypes as described in USSN 12/139,269
  misc_feature (1)..(88): Ceres CLONE ID no. 1088403
  misc_feature (1)..(88): Utility: Useful for making smaller plants
MGNETKGNGASSLGGGGGFRAKMEHYVYSGEKKHVLAGIGIFTVIFGIPWYLMNRGSNNHRSHQDYMEKADKARKARLSSSPSPSSDK

SEQ ID NO: 7757 - protein, 63 aa, Arabidopsis thaliana
  misc_feature (1)..(63): useful for making plants with modified plant phenotypes as described in USSN 12/139,269
  misc_feature (1)..(63): Ceres CLONE ID no. 30167
  misc_feature (1)..(63): Utility: Useful for making smaller plants
MEHYVYSGEKKHVLVGIGIVTIIFGVPWYLMTQGSKHQSHQDYMDKADKARKARLSSSSSANK

SEQ ID NO: 7758 - protein, 63 aa, Arabidopsis thaliana; identical to SEQ ID NO: 7757
  misc_feature (1)..(63): useful for making plants with modified plant phenotypes as described in USSN 12/139,269
  misc_feature (1)..(63): Ceres CLONE ID no. 154257
  misc_feature (1)..(63): Utility: Useful for making smaller plants

SEQ ID NO: 7759 - protein, 65 aa, Zea mays
  misc_feature (1)..(65): useful for making plants with modified plant phenotypes as described in USSN 12/139,269
  misc_feature (1)..(65): Ceres CLONE ID no. 299189
  misc_feature (1)..(65): Utility: Useful for making smaller plants
MEHYLYSGEKKHVVAGIAIFAAVFGVPWYFMTRGAKHQSHQDYMEKANKARSERLSSGQSSALKE

SEQ ID NO: 7760 - protein, 77 aa, Glycine max
  misc_feature (1)..(77): useful for making plants with modified plant phenotypes as described in USSN 12/139,269
  misc_feature (1)..(77): Ceres CLONE ID no. 1072510
  misc_feature (1)..(77): Utility: Useful for making smaller plants
MNSNSNVGGGFRSRLNHYLYSGDKKHVFVGLTLITAVFTIPWYFMSRGTKHQSHQDYLEKADKARSQRLSSSSASAK

SEQ ID NO: 7761 - protein, 81 aa, Triticum aestivum
  misc_feature (1)..(81): useful for making plants with modified plant phenotypes as described in USSN 12/139,269
  misc_feature (1)..(81): Ceres CLONE ID no. 870660
  misc_feature (1)..(81): Utility: Useful for making smaller plants
MGGEGASSSGGGFRARIDHYLYSGEKKHVVAGIAIFAAIFGVPWYLMTRGAKHDSHQDYVERANKARSDRLSSGQPSSLKE

SEQ ID NO: 7762 - protein, 81 aa, Triticum aestivum; identical to SEQ ID NO: 7761
  misc_feature (1)..(81): useful for making plants with modified plant phenotypes as described in USSN 12/139,269
  misc_feature (1)..(81): Ceres CLONE ID no. 1053154
  misc_feature (1)..(81): Utility: Useful for making smaller plants

SEQ ID NO: 7763 - protein, 81 aa, Triticum aestivum
  misc_feature (1)..(81): useful for making plants with modified plant phenotypes as described in USSN 12/139,269
  misc_feature (1)..(81): Ceres CLONE ID no. 568747
  misc_feature (1)..(81): Utility: Useful for making smaller plants
MGGEGASSSGGGFRARIDHYLYSGEKKHVVAGIAIFAAIFGVPWYFMTRGAKHDSHQDYMERANKARSDRLSSGQPSSLKE

SEQ ID NO: 7764 - protein, 79 aa, Glycine max
  misc_feature (1)..(79): useful for making plants with modified plant phenotypes as described in USSN 12/139,269
  misc_feature (1)..(79): Ceres CLONE ID no. 636196
  misc_feature (1)..(79): Utility: Useful for making smaller plants
MNSNSNSNVGGGFRSRLNHYLYSGDKKHVFVGLTLITAVFTIPWYFMSRGTKHQSHQDYLEKADKARSQRLSSSSASAK

SEQ ID NO: 7765 - DNA, 1524 bp, Glycine max
  misc_feature (1)..(1524): useful for making plants with modified plant phenotypes as described in USSN 12/139,269
  misc_feature (1)..(1524): Ceres CLONE ID no. 609573
  misc_feature (1)..(1524): Also known as  Ceres CDNA ID no. 23705836
atggagactggtggtggacgcgattctggcatgagttctgagactatcaattcctccactcaaagaacttcaatgagcaacgagagcgtttgcagcaccagcttcagccgtctctccttcgatctccctcctccttcttcttcccctgagaccctcttcgtcaaaccccaccgctcctccgacttcgcctactccgccatcctccgccgcaagtccgccctcaccttccgcgacttccacctcctccgccgcatcggcgccggcgacatcggcaccgtctacctctgccgtctccgccacgacgccggcgacgaggacgacgacgaggacccctgtttctacgcgatgaaggtggtggacaaggaggcggtggcgctgaagaagaaggcgcagagagcggagatggagaggaagattctgaagatggtggaccatccgttcctccctacgctctacgcggagttcgaggcttcgaatttctcatgcattgtgatggagtattgctccggtggggacttgcactcccttcaacacaaccaccccaataaccgattctctctctcctctgccaggttttacgcggctgaagtactggttgcgttggagtatctccacatgctgggaatcatctacagggatctgaagcccgaaaacgtgttggtcagatcagacggtcacatcatgctttccgacttcgatctctctctatgctccgatgctatcccagccgttgaatcccctgactgttcactggaccccgcattcgcacccgcgttacgctacactcgccagtactccacccccttctcctgcctctcgaaccgcgtattccggtccaggaaggtccagaccctccaacccaaccgcctcttcgtggccgaaccggtcggggcccgctcgtgctccttcgttgggacccacgagtacgtgtcgccggaagtggcctccgggaactcacacggcaatgccgtcgactggtggtccttcgggatattcatctacgagatggtgtacggtcgaacacccttcgcgggatcatcgaacgaggctacgctgcgaagcatcatcaaaaagcccctcgcatttcccacctccacgccctccagtacgcttgaaatgcacgcgcgggacctcatatcagggttgctcaacaaggacccgaaccgcaggctcgggtccaaacgaggctctgcggacgtcaaaaaacaccccttcttcgcggggctcaatctcgcgctcatccggacggtcacgccgccggaggttccatcactcagaaggcataaaacgacgccgttttactaccccgccaacgtaaataacagtagacagcagctaacggcgtttgattacttttgattaaaatccgacgatggtcgccccctgcgccacgccacgtgttcagtcggtgccccccagttttataattggcggatgggtgacttatgtgtatattttttagttgtcctttcttttttgtaacccttttttttaatataaaataacatagtttgatacttacgt

SEQ ID NO: 7766 - protein, 452 aa, Glycine max
  misc_feature (1)..(452): useful for making plants with modified plant phenotypes as described in USSN 12/139,269
  misc_feature (294)..(406): Pfam Name: Pkinase; Pfam Description: Protein kinase domain
  misc_feature (327)..(355): Pfam Name: Pkinase_Tyr; Pfam Description: Protein tyrosine kinase
  misc_feature (1)..(452): Utility: Useful for making smaller plants
METGGGRDSGMSSETINSSTQRTSMSNESVCSTSFSRLSFDLPPPSSSPETLFVKPHRSSDFAYSAILRRKSALTFRDFHLLRRIGAGDIGTVYLCRLRHDAGDEDDDEDPCFYAMKVVDKEAVALKKKAQRAEMERKILKMVDHPFLPTLYAEFEASNFSCIVMEYCSGGDLHSLQHNHPNNRFSLSSARFYAAEVLVALEYLHMLGIIYRDLKPENVLVRSDGHIMLSDFDLSLCSDAIPAVESPDCSLDPAFAPALRYTRQYSTPFSCLSNRVFRSRKVQTLQPNRLFVAEPVGARSCSFVGTHEYVSPEVASGNSHGNAVDWWSFGIFIYEMVYGRTPFAGSSNEATLRSIIKKPLAFPTSTPSSTLEMHARDLISGLLNKDPNRRLGSKRGSADVKKHPFFAGLNLALIRTVTPPEVPSLRRHKTTPFYYPANVNNSRQQLTAFDYF

SEQ ID NO: 7767 - protein, 445 aa, Glycine max
  misc_feature (1)..(445): useful for making plants with modified plant phenotypes as described in USSN 12/139,269
  misc_feature (1)..(445): Public GI no. 45271576
  misc_feature (1)..(445): Utility: Useful for making smaller plants
MSLETVNSNTQRTSLSSATESICSTSFSRLSFELLPSSSPESLSIKPHRSSDFAYSAIRKSGLTFRDFHLLRRIGSGDIGTVYLCRLRDSSVNYINDEDSSFYYAMKVVDKDAVALKKKSHRAEMERKILKMLDHPFLPSLYAEFEASNFSCIVMEFCSGGDLHSLRHRHPRNRFSLSSARFYAAEVLVALEYLHMLGIIYRDLKPENVLVRSDGHIMLSDFDLSLCSHAIPAVELSPDDPPLDVSCTRPHSISSPFKCLSKRLFRSRKVQTFQSNRLFVAEPVEARSCSFVGTHEYVSPEVASGNSHGNAVDWWSFGIFIYEMVYGRTPFAGPSNEATLRNIIKKPLSFPTATPSSTLEMHARDLISGLLNKDPNRRLGLKRGAADVKMHPFFVGLNLALIRMVTPPEVPGLRRNKTTPFVSGKDSNGNRSSSKQHPASSFDYF

SEQ ID NO: 7768 - protein, 460 aa, Glycine max
  misc_feature (1)..(460): useful for making plants with modified plant phenotypes as described in USSN 12/139,269
  misc_feature (1)..(460): Ceres CLONE ID no. 1361030
  misc_feature (1)..(460): Utility: Useful for making smaller plants
MLDTAERDSEVSLETVYSSTLGSSMSSESICSTSFSRLSFDLLPPSPETLSIKPHRSSDFAYSAAFRRKAALTFRDFHLLRRIGAGDIGTVYLCRLHNSNQLKNQDEDEEDVSCLYAMKVVDKDAVALKKKSQRAEMEKKILKMLDHPFLPTLYAEFEASHFSCIVMEFCSGGDLHSLRFKHPHNRFPLSSARFYAAEVLVALEYLHMLGIIYRDLKPENVLVRSDGHIMLSDFDLSLYSEAIPAVESSPDSLPSSNALPLPYAYTRSHSFMSPFSCFSNRSREVRTIEPNRLFVAEPVSARSCSFVGTHEYVSPKVASGRSHGNAVDWWSFGVFIYELIYGRTPYAGPSKEATLRNIVKKPLAFPTATPTSNLELHARDLISGLLNKDPARRLGSKRGAADVKKHPFFKGLNLALIRMQTPPEVPGSRRRTKTTSLYPVKGNGNNNHKQQQTASFDFYF

SEQ ID NO: 7769 - protein, 439 aa, Glycine max
  misc_feature (1)..(439): useful for making plants with modified plant phenotypes as described in USSN 12/139,269
  misc_feature (1)..(439): Public GI no. 1935918
  misc_feature (1)..(439): Utility: Useful for making smaller plants
MLLESDGEMSLETTNSPISSGTESCSSFSRLSFDAPPSTTAIIPEEESCLSLKPHRSSDFAYAEILRRRKHSLTFRDFRLMRRIGAGDIGTVYLCRLAGDQEESRSSYFAMKVVDNEALAMKKKMHRAEMEKKILKMLDHPFLPSLYAEFEASHFSCIVMEYCSGGDLHSLRHRQPQHRFSLSSARFYAAEVLVALEYLHMLGIIYRDLKPENILVRSDGHIMLSDFDLSLCSDSIAAVESSSSTPENYPHSSPRRLTRLAKLFNRVLRSKKVQTLEPNRLFVAEPVTARSGSFVGTHEYVAPEVASGGSHGNAVDWWAFGVFLYEIIYGRTPFAAPTNDVILRNIVKRPLSFPTDSPATMFELHARSLISGLLNKDPSTRLGSRRGAAEVKVHPFFKGLNFALIRTMTPPEVPSDVRRPKKSATFGGRSSKPAAFDFF

SEQ ID NO: 7770 - protein, 438 aa, Arabidopsis thaliana [sequence omitted]

SEQ ID NO: 7771 - protein, 461 aa, Arabidopsis thaliana
  misc_feature (1)..(461): useful for making plants with modified plant phenotypes as described in USSN 12/139,269
  misc_feature (1)..(461): Public GI no. 53749401
  misc_feature (1)..(461): Utility: Useful for making smaller plants
MAAAAASPTSSSSLPPKPPNSAAMLVEQQPLSYHDVDAASTPSSSVSSSSTASVGGRSSTFSLDSAATATPTSSPPRPHRAADVAWAPIRAAAAPLGPRDFTLVRRVGAGDIGTVYLCRLDGKRGAGSPSPCEYAMKVVDRRALAKKGKLGRAAAEKRVLRRLDHPFLPTMFADFDAGQDYSCVVMEFCPGGDLHSLRHRVPGRRFPVASARFYAAEVLLALEYLHMMGIVYRDLKPENVLIRADGHIMLTDFDLSLESTASPALEDARNGADDDPATPTCLPEVQLFRLRRWRRRAAPRRRPRFVAEPVDARSSSFVGTHEYVAPEVARGGGHGAGVDWWAYGVFLYELLYGRTPFVGATNEATLRNIVRRPLEFPPDAAGGGSPHDAAARDLIARLLDKDPRSRLGSRRGAADVKSHAFFKGLNFALLRSSAPPVVPPPAVAAAQCSKAADVPQLFDLF

SEQ ID NO: 7772 - DNA, 748 bp, Arabidopsis thaliana
  misc_feature (1)..(748): useful for making plants with modified plant phenotypes as described in USSN 12/139,269
  misc_feature (1)..(748): Ceres CLONE ID no. 4716
  misc_feature (1)..(748): Also known as  Ceres CDNA ID no. 23384157
acatgtacctaacttgttagtcaaacaaacaaaacaaaaaatccaagaagctttgaagaaccatggcgatgtctcatatccagcctgtgcttttcttccttgcatctctcttcttcttaccggctttgtgcagcgccatcgattttgaatattgcactaaaaatggacacgattacggtagcatctctcagatctgggtctctccctctgatgggcctcaggaaaacccaaccatcactatacatttattcggttctgcaagcaaagacatatccgcaggaacccttgtgtatgttacctatagatctggggattttacaggccttttaaaaacttacgacctatgtgatgtgagtgcatgtaaccctgaatatgtgattgaagctggcaccgactttgagttgactctttccgacgttctttatgttggttttgatgaggaaatcaagtattcggtatctttgcgcgaaaagacctcagaggagaagaatccaataataaaaatgtgtgtcgacttcaaagtacctcacccagcttttcctcctcctgcattggtctctatgtagtcaagttgacagatgaaaagatgtttccaagtctttgattatatgagtctcaacttgcatttccttttgtccctttttatatgttctccgacaaataaattaaaaccttggcttggttgatatgaaccaccatgtcttttctttgatttacttgttgatattaatcaaaaataaagttttct

SEQ ID NO: 7773 - protein, 88 aa, Arabidopsis thaliana
  misc_feature (1)..(88): useful for making plants with modified plant phenotypes as described in USSN 12/139,269
  misc_feature (24)..(71): Pfam Name: E1_DerP2_DerF2; Pfam Description: ML domain
  misc_feature (24)..(71): Pfam Name: E1_DerP2_DerF2; Pfam Description: ML domain
  misc_feature (1)..(88): Utility: Useful for making taller plants and plants with longer inflorescences
MAMSHIQPVLFFLASLFFLPALCSAIDFEYCTKNGHDYGSISQIWVSPSDGPQENPTITIHLFGSASKDISAEPLCMLPIDLGILQAF

SEQ ID NO: 7774 - DNA, 899 bp, Arabidopsis thaliana
  misc_feature (1)..(899): useful for making plants with modified plant phenotypes as described in USSN 12/139,269
  misc_feature (1)..(899): Ceres CLONE ID no. 23664
  misc_feature (1)..(899): Also known as  Ceres CDNA ID no. 23390268
aaagcaaattaaacccatcgataaacacatacgttcacacatatatgtctataaatccgacaatgtctcgtactggcgaaagttcttcaggttcgtcctccgacaagacgataaagctattcggcttcgaactcatcagcggcagtcgtacgccggaaatcacgacggcggaaagcgtgagctcgtccacaaacacgacgtcgttaacagtgatgaaaagacacgagtgccaatactgcggtaaagagtttgcaaattctcaagccttaggaggtcaccaaaacgctcacaagaaggagaggttgaagaagaagaggcttcagcttcaagctcggcgagccagcatcggctattatctcaccaaccaccaacaacccataacgacgtcatttcagagacaatacaaaacgccgtcgtattgtgcattctcctccatgcacgtgaataatgatcagatgggtgtgtacaacgaagattggtcgtcgaggtcgtcgcagattaacttcggtaataatgacacgtgccaagatcttaatgaacaaagcggtgagatgggtaagctgtacggtgttcgaccgaacatgattcagttccagagagatctgagttctcgttctgatcagatgagaagtattaactcgctggatcttcatctaggttttgccggagatgcggcataacaaattaaagagagatatatgattaagattatatgtactatagtggcgtatttcattgggatcatgaaggggaaaaaacgagacatatagtattcttgatgcaatttgagttttgtaatttatttaggtttatgtatgttttcgaagaaaaaaataattccaagtgatgttgtggaattattcaaaaaaagaaaaaaaactttattagatggctttact

SEQ ID NO: 7775 - protein, 211 aa, Arabidopsis thaliana
  misc_feature (1)..(211): useful for making plants with modified plant phenotypes as described in USSN 12/139,269
  misc_feature (60)..(82): Pfam Name: zf-C2H2; Pfam Description: Zinc finger, C2H2 type
  misc_feature (1)..(211): Utility: Useful for making taller plants and plants with longer inflorescences
MSINPTMSRTGESSSGSSSDKTIKLFGFELISGSRTPEITTAESVSSSTNTTSLTVMKRHECQYCGKEFANSQALGGHQNAHKKERLKKKRLQLQARRASIGYYLTNHQQPITTSFQRQYKTPSYCAFSSMHVNNDQMGVYNEDWSSRSSQINFGNNDTCQDLNEQSGEMGKLYGVRPNMIQFQRDLSSRSDQMRSINSLDLHLGFAGDAA

SEQ ID NO: 7776 - DNA, 1249 bp, Arabidopsis thaliana
  misc_feature (1)..(1249): useful for making plants with modified plant phenotypes as described in USSN 12/139,269
  misc_feature (1)..(1249): Ceres CLONE ID no. 3968
  misc_feature (1)..(1249): Also known as  Ceres CDNA ID no. 23367846
atcaccaaacattaagtagcactctttttcctctctatatctctcactcacactttttctctatatcttctcctcaacttggatatgggtgaagccgtagaggtcatgttcggaaatgggttcccggagattcacaaagccacatcacccactcaaaccctccactctaaccagcaagactgccattggtatgaagaaaccatcgatgatgatctcaagtggtcttttgccctcaacagtgttctccatcaaggaactagtgagtaccaagatattgctctgttggacaccaaacgttttggaaaggtgcttgtgattgatgggaaaatgcaaagtgctgagagagatgagtttatctaccatgaatgtttgatccatcccgctctccttttccatcccaaccccaagactgtgtttataatgggaggaggtgaaggctctgctgcaagagaaatactaaaacacacgacgatcgagaaagttgttatgtgtgatattgatcaggaagttgttgatttttgcagaagatttctgaccgttaacagcgatgctttctgtaacaagaagcttgaacttgtgatcaaagatgcaaaggctgaattagagaaaagggaagagaagtttgatatcatagtgggagatttagctgatccagtggaaggtggaccttgttatcagctctacaccaaatccttctaccaaaacattctcaaacccaagcttagccctaatggcatttttgtcacccaggctggaccagcaggaatattcactcataaggaagtcttcacatcaatctacaacaccatgaagcaagtcttcaagtacgtgaaggcttacacagcacatgtgccatcatttgcggacacatggggatgggtgatggcatcggaccatgagtttgacgttgaagttgatgaaatggatcgaagaatcgaagagagagttaacggagaattgatgtatctaaacgctccttctttcgtctctgctgctaccctcaacaaaaccatctctctcgcgctagagaaggagactgaagtttatagtgaagagaatgcgagattcattcatggtcatggtgtggcgtaccggcatatttaaagacgaaccggttcaatttcagtgtaataccaaacccatgtcacaaaaacaaaaagccggtttcttttctccgcacataaccgggtgttgtcttgaatcttgattactttggttcggttttattttctacattgcttttcgtttt

SEQ ID NO: 7777 - protein, 339 aa, Arabidopsis thaliana
  misc_feature (1)..(339): useful for making plants with modified plant phenotypes as described in USSN 12/139,269
  misc_feature (34)..(279): Pfam Name: Spermine_synth; Pfam Description: Spermine/spermidine synthase
  misc_feature (1)..(339): Utility: Useful for modifying seed structure and content
MGEAVEVMFGNGFPEIHKATSPTQTLHSNQQDCHWYEETIDDDLKWSFALNSVLHQGTSEYQDIALLDTKRFGKVLVIDGKMQSAERDEFIYHECLIHPALLFHPNPKTVFIMGGGEGSAAREILKHTTIEKVVMCDIDQEVVDFCRRFLTVNSDAFCNKKLELVIKDAKAELEKREEKFDIIVGDLADPVEGGPCYQLYTKSFYQNILKPKLSPNGIFVTQAGPAGIFTHKEVFTSIYNTMKQVFKYVKAYTAHVPSFADTWGWVMASDHEFDVEVDEMDRRIEERVNGELMYLNAPSFVSAATLNKTISLALEKETEVYSEENARFIHGHGVAYRHI

SEQ ID NO: 7778 - protein, 339 aa, Arabidopsis thaliana
  misc_feature (1)..(339): useful for making plants with modified plant phenotypes as described in USSN 12/139,269
  misc_feature (1)..(339): Public GI no. 18150168
  misc_feature (1)..(339): Utility: Useful for modifying seed structure and content
MGEAVEIMFGNGFPEIHKDTSPIQTLHSNQQDCHWYEETIDDDLKWSFALNSVLHQGTSEYQDIALLDTKRFGKVLVIDGKMQSAERDEFIYHECLIHPALLFHPNPKTVFIMGGGEGSAAREILKHTTIEKVVMCDIDQEVVDFCRRFLTVNSDAFCNKKLELVIKDAKAELEKREEKFDIIVGDLADPVEGGPCYQLYTKSFYQNILKPKLSPNGIFVTQAGPAGIFTHKEVFTSIYNTMKQVFKYVKAYTAHVPSFADTWGWVMASDHEFDVEVDEMDRRIEERVKGELMYLNAPSFVSAATLNKTISLALEKETEVYSEENARFIHGHGVAYRHI

SEQ ID NO: 7779 - protein, 349 aa, Arabidopsis thaliana
  misc_feature (1)..(349): useful for making plants with modified plant phenotypes as described in USSN 12/139,269
  misc_feature (1)..(349): Public GI no. 40788039
  misc_feature (1)..(349): Utility: Useful for modifying seed structure and content
MGSEALEFFSCANNNNNNNGFSYEPKKNIIMEETDNLSINIHDGSWFEEEIDVDLKWSFALNSVLHKGTSEYQDIALLDTKHFGKILVIDGKMQSAEVDEFIYHECLIHPALLCHPNPKNVFIMGGGEGSAAREALRHKSMEKVVMCDIDKEVVDFCKKHLTANHEAFLNKKLNLVINDAKAELEQRQEKFDIIVGDLADPVEGGPCYQLYTKSFYQNILKPKLNDTGIFVTQAGPAGVFTHKEVFSSIYNTTKQVFKYVLAYTAHVPSFADTWGWVMASDKPFCLDAGKLDKKIAERIEGELLYLNGASFFSSTILNKTVAKTLKNESHVYAEDDARFIHGHGLGFRN

SEQ ID NO: 7780 - protein, 344 aa, Arabidopsis thaliana
  misc_feature (1)..(344): useful for making plants with modified plant phenotypes as described in USSN 12/139,269
  misc_feature (1)..(344): Public GI no. 50252842
  misc_feature (1)..(344): Utility: Useful for modifying seed structure and content
MVGAVQEGIVREMNGGFEVMSGYDRSSMAPKQQQREEESKWYEEEIDDDLKLCYALNSVLHRGASKYQEIALIDTKHFGKALIIDGKMQSTEVDEFIYHESLIHPPLLFHPNPKTVFIMGGGEGSAAREVLRHNTVHRVVMCDIDQEVVDFCRTYLTVNWDAFASDKLCLIINDARAELEKSREKFDVIVGDLADPVEGGPCYQLYTKSFYQHIVKPKLNDRGVFVTQAGPAGVLTHKEVFSSIYNTLRHVFKYVKAYTAHVPSFADTWGWVMASDYPFSMNAQQINERIKERIDGELVYLSGESLISSTILNKSVYQSLLNETHVYTEDDARFIYGHGRARCA

SEQ ID NO: 7781 - protein, 380 aa, Arabidopsis thaliana
  misc_feature (1)..(380): useful for making plants with modified plant phenotypes as described in USSN 12/139,269
  misc_feature (1)..(380): Public GI no. 38602797
  misc_feature (1)..(380): Utility: Useful for modifying seed structure and content
FSIKGNGIGNGNGHCNGYSNGHGHCINGYSNGISASVSSNGVSHLPYSNGNTVHHSNSNGHIHTSPSFGDGRRRCFWYEEEIEDDLRWCFALNRILHTGVSEYQDIALIDTRPFGKALVIDGKMQSTEVDEFIYHESLVHPALVYHSQPKSAFIMGGGEGSTAREILRHKCVKKVVMCDIDKEVVDFCKKYLVVNREAFSNSRLELVINDARTELQSRQERFDVIIGDLADPVEGGPCYQLYTKSFYELVIKPKLNHQGIFVTQAGPAGVLTHTQVFSSIYNTLRQVFKHVMPYSAHVPSFADTWGWVMASDHPLTLEAGEIDDRIKQRIKGELQFLDGQTFLVAATLNKSVRKSLSKETHVYTEETARFIHGHGKASYQ

SEQ ID NO: 7782 - DNA, 877 bp, Arabidopsis thaliana; identical to SEQ ID NO: 5259
  misc_feature (1)..(877): useful for making plants with modified plant phenotypes as described in USSN 12/139,269
  misc_feature (1)..(877): Ceres CLONE ID no. 98850
  misc_feature (1)..(877): Also known as  Ceres CDNA ID no. 23448883

SEQ ID NO: 7783 - protein, 192 aa, Arabidopsis thaliana; identical to SEQ ID NO: 5260
  misc_feature (1)..(192): useful for making plants with modified plant phenotypes as described in USSN 12/139,269
  misc_feature (9)..(59): Pfam Name: SRF-TF; Pfam Description: SRF-type transcription factor (DNA-binding and dimerisation domain)
  misc_feature (113)..(162): Pfam Name: K-box; Pfam Description: K-box region
  misc_feature (9)..(59): Pfam Name: SRF-TF; Pfam Description: SRF-type transcription factor (DNA-binding and dimerisation domain)
  misc_feature (113)..(162): Pfam Name: K-box; Pfam Description: K-box region

SEQ ID NO: 7784 - protein, 196 aa, Arabidopsis thaliana; identical to SEQ ID NO: 5852
  misc_feature (1)..(196): useful for making plants with modified plant phenotypes as described in USSN 12/139,269
  misc_feature (1)..(196): Ceres CLONE ID no. 92459

SEQ ID NO: 7785 - protein, 196 aa, Arabidopsis thaliana; identical to SEQ ID NO: 5852
  misc_feature (1)..(196): useful for making plants with modified plant phenotypes as described in USSN 12/139,269
  misc_feature (1)..(196): Public GI no. 21617978

SEQ ID NO: 7786 - protein, 205 aa, Arabidopsis thaliana; identical to SEQ ID NO: 5856
  misc_feature (1)..(205): useful for making plants with modified plant phenotypes as described in USSN 12/139,269
  misc_feature (1)..(205): Public GI no. 51968502

SEQ ID NO: 7787 - protein, 198 aa, Arabidopsis thaliana
  misc_feature (1)..(198): useful for making plants with modified plant phenotypes as described in USSN 12/139,269
  misc_feature (1)..(198): Public GI no. 32402402
MGRRRVEIKRIENKSSRQVTFCKRRNGLMEKARQLSILCGSSVALFIVSSTGKLYNSSSGDSMAKIISRFKIQQADDPETLDLEDKTQDYLSHKELLEIVQRKIEEAKGDNVSIESLISMEEQLKSALSVIRARKTELLMELVKNLQDKEKLLKEKNKVLASEVGKLKKILETGDERAVMSPENSSGHSPPETLPLLK

SEQ ID NO: 7788 - protein, 200 aa, Arabidopsis thaliana
  misc_feature (1)..(200): useful for making plants with modified plant phenotypes as described in USSN 12/139,269
  misc_feature (1)..(200): Public GI no. 29165411
MGRRKVEIKRIENKSSRQVTFCKRRNGLMEKARQLSILCESSVALIIISATGRLYSFSSGDSMAKILSRYELEQADDLKTLDLEEKTLNYLSHKELLETIQCKIEEAKSDNVSIDCLKSLEEQLKTALSVTRARKTELMMELVKTHQEKEKLLREENQSLTNQLIKMGKMKKSVEAEDARAMSPESSSDNKPPETLLLLK

SEQ ID NO: 7789 - protein, 197 aa, Brassica napus; identical to SEQ ID NO: 5237
  misc_feature (1)..(197): useful for making plants with modified plant phenotypes as described in USSN 12/139,269
  misc_feature (1)..(197): Ceres CLONE ID no. 1065387

SEQ ID NO: 7790 - protein, 197 aa, Brassica napus; identical to SEQ ID NO: 5237
  misc_feature (1)..(197): useful for making plants with modified plant phenotypes as described in USSN 12/139,269
  misc_feature (1)..(197): Public GI no. 17933450

SEQ ID NO: 7791 - protein, 196 aa, Brassica napus; identical to SEQ ID NO: 5235
  misc_feature (1)..(196): useful for making plants with modified plant phenotypes as described in USSN 12/139,269
  misc_feature (1)..(196): Public GI no. 31580813

SEQ ID NO: 7792 - protein, 196 aa, Brassica napus; identical to SEQ ID NO: 5241
  misc_feature (1)..(196): useful for making plants with modified plant phenotypes as described in USSN 12/139,269
  misc_feature (1)..(196): Public GI no. 17933458

SEQ ID NO: 7793 - protein, 197 aa, Brassica napus; identical to SEQ ID NO: 5236
  misc_feature (1)..(197): useful for making plants with modified plant phenotypes as described in USSN 12/139,269
  misc_feature (1)..(197): Public GI no. 34591565

SEQ ID NO: 7794 - protein, 196 aa, Brassica napus; identical to SEQ ID NO: 5239
  misc_feature (1)..(196): useful for making plants with modified plant phenotypes as described in USSN 12/139,269
  misc_feature (1)..(196): Public GI no. 17933456

SEQ ID NO: 7795 - protein, 196 aa, Brassica napus; identical to SEQ ID NO: 5239
  misc_feature (1)..(196): useful for making plants with modified plant phenotypes as described in USSN 12/139,269
  misc_feature (1)..(196): Ceres CLONE ID no. 1091989

SEQ ID NO: 7796 - protein, 196 aa, Arabidopsis thaliana
  misc_feature (1)..(196): useful for making plants with modified plant phenotypes as described in USSN 12/139,269
  misc_feature (1)..(196): Ceres CLONE ID no. 39347
MGRKKLEIKRIENKSSRQVTFSKRRNGLIEKARQLSVLCDASVALLVVSASGKLYSFSSGDNLVKILDRYGKQHADDLKALDHQSKALNYGSHYELLELVDSKLVGSNVKNVSIDALVQLEEHLETALSVTRAKKTELMLKLVENLKEKEKMLKEENQVLASQMENNHHVGAEAEMEMSPAGQISDNLPVTLPLLN

SEQ ID NO: 7797 - DNA, 1349 bp, Zea mays
  misc_feature (1)..(1349): Ceres CLONE ID no.241491
  misc_feature (1)..(1349): useful for making plants with altered flowering time as described in USSN 12/281,616
agcacttgtgtccggcggccttgtgttcgtgggggtgtgtggcatattagctagcggataagcggccggccgaagagcgcgcaacrcggtgagaagaagaagcaagctcggatcggaggaggtcggcatggggaggggacgcgtcgagctgaagcggatcgagaacaagatcaaccgccaggtcaccttctccaagcgccgcaacggcctgctcaagaaggcctacgagctctccgtgctctgcgacgccgaggtcgcgctcatcatcttctccggccgcggcaagctctacgagttcggcagcgccggcgtaactaaaactttagaaaggtatcaacatttctgctacaatgctcaagattccaacaatggtgcactctctgaatctcagagctggtaccaggaaatatcaaaactgagggcaaaattcgaggccttgcagcgcactcagagacacttgcttggggaggaccttggcccactgagtactgtgaaggaattgcagcagctagagaaacagctagaatgtgctttgtcacaggcaagacagagaaagacgcaacttatgatggagcaagtggaagagcttcgccgaacggtattttatactagactttgtttacaatagtaaaactgatctacagcatagtaggttgatacaccgtagccagctcgggcatatatatactctatatatcgcatgcacagcagggataatcatatggacgttctttagctgaaaaactgtctgtgtaggtaggtatgcctatatatgtgtcttccgatccttgtactcttctgcacaacagattcagccgttcaccttaatgtctaaagtattcgccacattctcatggactgcgcaggagcgtcacctgggagaaatgaacaggcaactcaaacacaagctcgaagctgaaggctgtagcaactacacaaccttgcagcatgccgcctgctggccagctcccggcggcaccatcgtggagcatgacggcgccacctatcaagtgcatccgcctgcccactcagttgctatggactgtgaacccactctgcaaatcgggtaccctcatcaccagtttccgccccctgaggcagccaataatatcccaaggagcgccgccacaggcgagaacaacttcatgctgggatgggttctttgagttcttctgttaatccatccatcagatggatccatgttgaaaccaataaaaggcattcagtgctatatatatcatatgcatatccgtgctcaagtgcttgatttgccacgacgttggattgtatcgttctgtgtgtaatagctaatttagaacggcacatctattctatgtggttgtggtgtg

SEQ ID NO: 7798 - protein, 166 aa, Zea mays
  misc_feature (1)..(166): Ceres CLONE ID NO.241491
  misc_feature (74)..(174): Pfam Name: K-box Pfam Description: K-box region
  misc_feature (9)..(59): Pfam Name: SRF-TF Pfam Description: SRF-type transcription factor
  misc_feature (1)..(166): useful for making plants with altered flowering time as described in USSN 12/281,616
MGRGRVELKRIENKINRQVTFSKRRNGLLKKAYELSVLCDAEVALIIFSGRGKLYEFGSAGVTKTLERYQHFCYNAQDSNNGALSESQSWYQEISKLRAKFEALQRTQRHLLGEDLGPLSTVKELQQLEKQLECALSQARQRKTQLMMEQVEELRRTVFYTRLCLQ

SEQ ID NO: 7799 - DNA, 962 bp, Oryza sativa
  misc_feature (1)..(962): Ceres ANNOT ID no.1241081
  misc_feature (14)..(14): n is a, c, t, g, unknown, or other
  misc_feature (1)..(962): useful for making plants with altered flowering time as described in USSN 12/281,616
gcaaaagttgaggnaatggatcgatcagagatggggaggggaagggttgagctgaagcgcatcgagaacaagatcaaccggcaggtcaccttctccaagcgccgcaacggcctcctcaagaaggcgtacgagctctccgtgctctgcgacgcggaggtggcgctcatcatcttctccagccgtggcaagctgtacgaattcggtagcgccggaataaacaagacattggaaaagtacaatagttgctgttacaacgctcaaggttcaaatagtgctcttgctggtggtgaacatcagagctggtaccaagagatgtcaaggctcaagactaagcttgaatgtctccaacgctctcagaggcacatgcttggtgaagatcttggaccattgagcataaaggaactgcagcagctggagaagcaacttgagtactcactgtcacaggctcgacaacgaaagacacaaatcatgatggagcaggtcgacgatcttcgccggaaggaacgccagcttggagagctcaataagcaactgaaaaacaagctagaagctgaagccgatagcagcaactgcagatcagccatccaggattcctgggtccatggcaccgtcgtcagtggcggcagagtgctgaatgctcaaccaccaccagatattgactgtgagcctactctgcaaattgggtactatcaatttgtccgtcctgaggcggccaatccaagaagcaatggaggaggaggggatcagaacaacaactttgtgatgggatggcccctctgaagtccaagcttgctaataaaaacgctggcgtgctataatatatagttcggcaaatgttgaaacacatgtgttctcagtatgtatatttctcccctatccggtggtactcttagcacgtacctatgagtgtatgtttgtacgttatctatactctatgctaggcaaccctatactattatggt

SEQ ID NO: 7800 - protein, 254 aa, Oryza sativa
  misc_feature (1)..(254): Ceres ANNOT ID NO.1241081
  misc_feature (14)..(64): Pfam Name: SRF-TF Pfam Description: SRF-type transcription factor
  misc_feature (79)..(179): Pfam Name: K-box Pfam Description: K-box region
  misc_feature (1)..(254): Functional Homolog of  Ceres CLONE NO.241491
  misc_feature (1)..(254): useful for making plants with altered flowering time as described in USSN 12/281,616
MDRSEMGRGRVELKRIENKINRQVTFSKRRNGLLKKAYELSVLCDAEVALIIFSSRGKLYEFGSAGINKTLEKYNSCCYNAQGSNSALAGGEHQSWYQEMSRLKTKLECLQRSQRHMLGEDLGPLSIKELQQLEKQLEYSLSQARQRKTQIMMEQVDDLRRKERQLGELNKQLKNKLEAEADSSNCRSAIQDSWVHGTVVSGGRVLNAQPPPDIDCEPTLQIGYYQFVRPEAANPRSNGGGGDQNNNFVMGWPL

SEQ ID NO: 7801 - DNA, 738 bp, Populus balsamifera subsp. trichocarpa
  misc_feature (1)..(738): Ceres ANNOT ID no.1524415
  misc_feature (1)..(738): useful for making plants with altered flowering time as described in USSN 12/281,616
atgggaagaggaagagtggagttgaagaggatagagaacaagatcaaccgacaagttaccttctctaaaagaaggaatggcttgcttaagaaagcttatgagctttcagtgctttgtgatgctgaggttgcccttatcatcttctccagtcgtggcaagctctatgaatttggtagtgctagtgttaccaaaacccttgagcgttatcaacgctgctgctacactccacaagagaacagcattgaacgtgagacacagagctggtacctagaggcgacaaagttaaaggcaaagtatgaatcccttcaacgcactcaaaggcatttgcttggggaggatcttgggcccctgaatgtgaaagagctacaaaatcttgagaaacagcttgaaggagctcttgcacttgctaggcagagaaagcagcaggttttgacagagcaaatggaagacctgcgcaaaaaggaacgtcaccttggagacttgaacaggcatctcaaacttaagctagaagcagaaggacaaaatcttaaagccattcaagactattggaactctggtgcagcagatggaagtagcaacttccacttgcatcgtgctcaatccagccagatggactgtgatccagggcctgtcttacaaattgggtatcatcactatgttccagctgaaggatcctctgtgtctgcttcaaaaagcatgcctgacgagactaacttcttccagggatggatcctttga

SEQ ID NO: 7802 - protein, 245 aa, Populus balsamifera subsp. trichocarpa
  misc_feature (1)..(245): Ceres ANNOT ID NO.1524415
  misc_feature (74)..(171): Pfam Name: K-box Pfam Description: K-box region
  misc_feature (9)..(59): Pfam Name: SRF-TF Pfam Description: SRF-type transcription factor
  misc_feature (1)..(245): Functional Homolog of  Ceres CLONE NO.241491 with e-value of 1.00E-73 and BLAST sequence identity of 68.5
  misc_feature (1)..(245): useful for making plants with altered flowering time as described in USSN 12/281,616
MGRGRVELKRIENKINRQVTFSKRRNGLLKKAYELSVLCDAEVALIIFSSRGKLYEFGSASVTKTLERYQRCCYTPQENSIERETQSWYLEATKLKAKYESLQRTQRHLLGEDLGPLNVKELQNLEKQLEGALALARQRKQQVLTEQMEDLRKKERHLGDLNRHLKLKLEAEGQNLKAIQDYWNSGAADGSSNFHLHRAQSSQMDCDPGPVLQIGYHHYVPAEGSSVSASKSMPDETNFFQGWIL

SEQ ID NO: 7803 - DNA, 2250 bp, Arabidopsis thaliana
  misc_feature (1)..(2250): Ceres ANNOT ID no.158140
  misc_feature (1)..(2250): useful for making plants with altered flowering time as described in USSN 12/281,616
aaaccacacacacagcttcttcactgagagcttttttctagggtttctctctttgtttcttacaatgcgactcttcttcacaccgtcaatgtccaatctctccatattcttctcgattcttctcctttctcttcctcttccgtcaatcggagatctcgccgccgacaaatccgctcttctctcttttcgttccgccgtcggtggtcgtacattactctgggacgtcaagcaaacctcaccatgcaactggaccggcgtcttatgcgacggtggtcgtgttactgctcttcgtcttcccggtgaaacgctctccggtcatataccggagggtatttttggtaatttaactcagctccggacgcttagtctccgtctcaatggtcttactggttctcttcctttggatctcggaagctgctccgatcttcggcgtttgtacctgcagggtaacagattctccggtgagattccggaggttttgtttagtcttagtaaccttgttaggttgaatctagctgagaatgaatttagtggagagatctcgtcagggtttaaaaaccttactaggcttaagactctgtacctggagaataacaagctctctggctctcttttagacttggatttgtctttggatcagttcaacgtttctaataacttgttgaacggatctatacctaagagtttgcagaagtttgattctgattcgtttgtgggaacttctctctgcggcaaaccgcttgttgtctgctctaatgagggaactgtgccaagccagccaatttctgttggcaatattcccggaactgttgaaggaagtgaggagaagaagaaaaggaagaagctttctggtggagctatagctggaatagtgattggatgtgtggttggtttgtccctgattgttatgattttgatggttctctttaggaaaaaggggaacgagagaacaagggccattgaccttgcaaccatcaagcaccatgaagttgaaattcctggcgagaaagcggccgtggaagcaccggagaataggagctatgtaaatgagtactctccgtctgcagtgaaagctgtggaagtgaacagttcagggatgaagaagttagtgttttttgggaatgcgacaaaggtcttcgatcttgaggatctgttgagagcttcagcggaggttctggggaaaggaacgttcgggacagcttataaagcggtgcttgacgcggtgacattggtggctgtgaagagactgaaggatgtaacgatggcggacagagagtttaaggagaagattgaggttgttggggcgatggatcatgagaacttggtgcccttgagagcgtactattacagtggagacgagaagctgcttgtctatgacttcatgcctatgggaagcttatcagctctcttacacggaaacaaaggtgcaggccggcctccattgaactgggaagtcagatcaggcatcgcccttggagctgctcgtggcttagactatcttcactcacaagacccactgagctctcacggaaacgtcaagtcctccaatatcctcttaacaaactcccatgacgcacgagtgtctgatttcggcctggctcagcttgtaagcgcctcatccacaaccccaaaccgggccactgggtaccgtgcgccagaagtaactgacccgaggcgtgtctcacagaaagcggacgtgtacagctttggtgtggtgttgctagagttgctcaccggaaaagctccgtctaactcggtgatgaacgaggaaggaatggatttggcgaggtgggtgcattcagtggcgagagaggagtggaggaatgaggtttttgactcggagctgatgagtatcgagacagttgtctcggtggaagaagagatggcggaaatgctgcagctgggcattgactgtacagagcagcacccagacaagcggccagttatggtggaggtggtgagaaggatccaggagttgcgccaatcgggtgcagatcgggtggggtaagaccatcagatgaaaggagacttgagacatgagtctgttcgatgatctgaagcggcgacgttttcagtgtttagttttaagaatatggcgggaattagagttggggtcgttaattagatgtttttaattttggttttttttttttggtttctttcatgtgtgggcactgatgatgaggagtttcgtggtggttgtaattattagtgcttttaactttaactttattttcaatattgtttttc

SEQ ID NO: 7804 - protein, 216 aa, Arabidopsis thaliana
  misc_feature (1)..(216): Ceres ANNOT ID NO.158140
  misc_feature (1)..(216): Functional Homolog of  Ceres CLONE NO.241491 with e-value of 1.09E-69 and BLAST sequence identity of 59.8
  misc_feature (159)..(159): Xaa is any aa, unknown, or other
  misc_feature (160)..(160): Xaa is any aa, unknown, or other
  misc_feature (161)..(161): Xaa is any aa, unknown, or other
  misc_feature (1)..(216): useful for making plants with altered flowering time as described in USSN 12/281,616
KRIENKKNRQVTFSKRRNGLLKKAAELSVLCDAEVAAIIFSSSGKLYYYYYYYYYYPPPPPPPPPPPKRIENKINRQVTFSKRRNGLLKKAYELSVLCDAEVALIIFSSRGKLYYYYEYSSSSEEESSSSSSSSSSPPPPPPPPEFGSSSSSSSKKKKXXXDDMAINNNNNFFFFFFRRMMMMMTTTTTTTTSCCREEEEEEEEEEEEEEEEEEEE

SEQ ID NO: 7805 - DNA, 723 bp, Gossypium hirsutum
  misc_feature (1)..(723): Ceres CLONE ID no.1932523
  misc_feature (1)..(723): useful for making plants with altered flowering time as described in USSN 12/281,616
aaaaaaaaaaaaaaaaaaaaaaaaaaaaaaaaaaaaagccattgttctaaaaccaaaaaaaaatggggagaggaagagtggagctgaagaggatagaaaacaagatcaacagacaagtgaccttctctaagagaagaaatggtttgcttaaaaaagcttatgagctttctgttctttgtgatgctgaggttgctcttatcatcttctctagtcgtggcaagctctacgagtttggcagttcaggtatgagcaagacccttgagcgataccagcgttgctgctttactcctcaagacaacagccttgaacgcgaaacacagaattggtaccaagaggtaaccaagttaaaggcaaaatatgaagcactgcaacgcactcaaaggcatttgcttggagaagatcttggaccattgaatgttaaggagctgcaaaaccttgagaaacagcttgaaggagctcttgcactggctagacaaaggaagacacagatcatgatagaacaaatggaagacctccgtaaaaaggagcgtgagcttggagaccttaacaaacagctgaaaatcaagctagaggcagaaggacaaaacctcaaaacaatccaaggtttatggagtagtggtgcagcagctgaaactagcaactttcctctgcatccttctcacccacatcctatgggattgtgatcatgaacctgttctgcaaatagggtaccatcactttgtt

SEQ ID NO: 7806 - protein, 243 aa, Gossypium hirsutum
  misc_feature (1)..(243): Ceres CLONE ID NO.1932523
  misc_feature (1)..(243): Functional Homolog of  Ceres CLONE NO.241491 with e-value of 4.59E-78 and BLAST sequence identity of 70.9
  misc_feature (1)..(243): useful for making plants with altered flowering time as described in USSN 12/281,616
MGRGRVELKRIENKINRQVTFSKRRNGLLKKAYELSVLCDAEVALIIFSSRGKLYEFGSSGMSKTLERYQRCCFTPQDNSLERETQNWYQEVTKLKAKYEALQRTQRHLLGEDLGPLNVKELQNLEKQLEGALALARQRKTQIMIEQMEDLRKKERELGDLNKQLKIKLEAEGQNLKTIQGLWSSGAAAETSNFPLHPSHPHPMDCDHEPVLQIGYHHFVQAEGSSVPKSMAGETNFIHGWVI

SEQ ID NO: 7807 - protein, 258 aa, Triticum aestivum
  misc_feature (1)..(258): Public GI ID NO.3688591
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(258): Functional Homolog of  Ceres CLONE NO.241491 with e-value of 1.70E-101 and BLAST sequence identity of 84.8
  misc_feature (1)..(258): useful for making plants with altered flowering time as described in USSN 12/281,616
MGRGRVELKRIENKINRQVTFSKRRNGLLKKAYELSVLCDAEVALIIFSSRGKLYEFGSAGTTKTLERYQHCCYNAQDSNGALSETQSWYQEMSKLKAKFEALQRTQRHLLGEDLGPLSVKELQQLEKQLECSLSLARQRKTQLMMEQVEELRRKERQLGDINRQLKHKLDAEGSNSNNYRAMQQISWAAGTVVDEGAAAYHMQQQQQHPNHSAAMDCEPTLQIGYHHQFAAPDQAANNIPRSSAPGGENNFMLGWVL

SEQ ID NO: 7808 - protein, 263 aa, Hordeum vulgare subsp. vulgare
  misc_feature (1)..(263): Public GI ID NO.44888603
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(263): Functional Homolog of  Ceres CLONE NO.241491 with e-value of 4.50E-103 and BLAST sequence identity of 85.2
  misc_feature (1)..(263): useful for making plants with altered flowering time as described in USSN 12/281,616
MGRGRVELKRIENKINRQVTFSKRRNGLLKKAYELSVLCDAEVALIIFSSRGKLYEFGSAGTTKTLERYQHCCYNAQDSNGALSETQSWYQEMSKLKAKFEALQRTQRHLLGEDLGPLSVKELQQLEKQLECSLSQARQRKTQLMMEQVEELRRKERQLGDINRQLKHKLDAEGSNSNNYRTMQQITWAAGTVVDEGAAAYHMQQQQQQQQQHPNHSAAMDCEPTLQIGYPHHQFAAPDQVANNIPRSSAPGGENNFMLGWVL

SEQ ID NO: 7809 - protein, 249 aa, Dendrocalamus latiflorus
  misc_feature (1)..(249): Public GI ID NO.47681319
  misc_feature (74)..(171): Pfam Name: K-box Pfam Description: K-box region
  misc_feature (9)..(59): Pfam Name: SRF-TF Pfam Description: SRF-type transcription factor
  misc_feature (1)..(249): Functional Homolog of  Ceres CLONE NO.241491 with e-value of 1.30E-103 and BLAST sequence identity of 87.0
  misc_feature (1)..(249): useful for making plants with altered flowering time as described in USSN 12/281,616
MGRGKVELKRIENKINRQVTFSKRRNGLLKKAYELSVLCDAEVALIIFSSRGKLYEFGSAGISKTLERYQHCCYNAQDNNALSETQIWYQEMSKLRAKFEALQRTQRHLLGEDLGPLSVKELQQLEKQLECALSQARQRKTQLMMEQVEELRKKERQLGEINRQLKHKLEAEGSSNYRAMHRASWAPGTVVDEGAAYHEQQPPHSAALDCEPPTLQIGYPHQFMPPEAANIPRSAPAGGENNFMLGWVL

SEQ ID NO: 7810 - protein, 250 aa, Oryza sativa subsp. japonica
  misc_feature (1)..(250): Public GI ID NO.50251892
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(250): Functional Homolog of  Ceres CLONE NO.241491
  misc_feature (1)..(250): useful for making plants with altered flowering time as described in USSN 12/281,616
MGRGRVELKRIENKINRQVTFSKRRNGLLKKAYELSVLCDAEVALIIFSSRGKLYEFGSAGITKTLERYQHCCYNAQDSNNALSETQSWYHEMSKLKAKFEALQRTQRHLLGEDLGPLSVKELQQLEKQLECALSQARQRKTQLMMEQVEELRRKERQLGEINRQLKHKLEVEGSTSNYRAMQQASWAQGAVVENGAAYVQPPPHSAAMDSEPTLQIGYPHQFVPAEANTIQRSTAPAGAENNFMLGWVL

SEQ ID NO: 7811 - protein, 255 aa, Zea mays
  misc_feature (1)..(255): Public GI ID NO.939779
  misc_feature (1)..(255): Functional Homolog of  Ceres CLONE NO.241491 with e-value of 4.50E-119 and BLAST sequence identity of 92.8
  misc_feature (1)..(255): useful for making plants with altered flowering time as described in USSN 12/281,616
MGRGRVELKRIENKINRQVTFSKRRNGLLKKAYELSVLCDAEVALIIFSSRGKLYEFGSAGITKTLERYQHCCYNAQDSNGALSETQSWYQEMSKLRAKFEALQRTQRHLLGEELGPLSVKELQQLEKQLECALSQARQRKTQLMMEQVEELRRKERHLGEMNRQLKHKLEAEGCSNYRTLQHAAWPAPGSTMVEHDGATYHVHPTTAQSVAMDCEPTLQIGYPPHHQFLPSEAANNIPRSPPGGENNFMLGWVL

SEQ ID NO: 7812 - protein, 255 aa, Zea mays
  misc_feature (1)..(255): Public GI ID NO.939781
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(255): Functional Homolog of  Ceres CLONE NO.241491 with e-value of 9.60E-133 and BLAST sequence identity of 98.0
  misc_feature (1)..(255): useful for making plants with altered flowering time as described in USSN 12/281,616
MGRGRVELKRIENKINRQVTFSKRRNGLLKKAYELSVLCDAEVALIIFSGRGKLYEFGSAGVTKTLERYQHCCYNAQDSNNSALSESQSWYQEMSKLRAKFEALQRTQRHLLGEDLGPLSVKELQQLEKQLECALSQARQRKTQVMMEQVEELRRTERHLGEMNRQLKHKLEAEGCSNYTTLQHAACWPAPGGTIVEHDGATYQVHPPAHSVAMDCEPTLQIGYPHHQFPPPEAVNNIPRSAATGENNFMLGWVL

SEQ ID NO: 7813 - protein, 242 aa, Pinus radiata
  misc_feature (1)..(242): Public GI ID NO.1206005
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(242): Functional Homolog of  Ceres CLONE NO.241491 with e-value of 5.19E-70 and BLAST sequence identity of 67.6
  misc_feature (1)..(242): useful for making plants with altered flowering time as described in USSN 12/281,616
MGRGRVELKRIENKINRQVTFSKRRNGLLKKAYELSVLCDAEVALIIFSSRGKLYEFGSAGMLKTLERYQKCSYVLQDATVSDREAQNWHQEVGKLKARVELLQRSQRHLLGEDLGPLSIKELQQLERQLEVALTHVRSRKTQVMLEMMDELRRKERILQEVNKSLRKKLQEAEGQAFNAMQPPPHAWDSHAVANNAYAMQHPSNAVDCEPTLQIGYQYAPPESSMPRHEQAQNNYMQGWMV

SEQ ID NO: 7814 - protein, 242 aa, Pinus resinosa
  misc_feature (1)..(242): Public GI ID NO.1702951
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(242): Functional Homolog of  Ceres CLONE NO.241491 with e-value of 1.80E-69 and BLAST sequence identity of 67.2
  misc_feature (1)..(242): useful for making plants with altered flowering time as described in USSN 12/281,616
MGRGRVELKRIENKINRQVTFSKRRNGLLKKAYELSVLCDAEVALIIFSSRGKLYEFGSAGMLKTLERYQKCSYVLQDATVSDREAQNWHQEVGKLKARVELLQRSQRHLLGEDLGPLSIKELQQLERQLEVALTHVRSRKTQVMLEMMDELRRKERILQEVNKSLRKKLQEAEGQAFNAMQPPPHAWDSHAVANNAYAMQHPSNAVDCEPTLQTGYQYAPPESSMPRHEQAQNNYMQGWMV

SEQ ID NO: 7815 - protein, 261 aa, Pinus radiata
  misc_feature (1)..(261): Public GI ID NO.2160701
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(261): Functional Homolog of  Ceres CLONE NO.241491 with e-value of 5.09E-63 and BLAST sequence identity of 60.8
  misc_feature (1)..(261): useful for making plants with altered flowering time as described in USSN 12/281,616
MGRGRVQLRRIENKINRQVTFSKRRNGLLKKAYELSVLCDAEVALIIFSTRGKLYEFASSSMNKTLERYEKCSYAMQDTTGVSDREAQNWHQEVTKLKGKVELLQRSQRHLLGEDLGPLNVKELQQLERQLEVALTHLRSRKTQVMLDQIEELRQRERLLHEVNKSLQKKLSETEGRDVITGIEQTSNTNTGTNGPWDSSITNTAYALSHPQQDSNSSLHHVDCEPTLQIGYQPVAPESIVPPHQPPHNQTPNQYMQGWWV

SEQ ID NO: 7816 - protein, 252 aa, Arabidopsis thaliana
  misc_feature (1)..(252): Public GI ID NO.2979564
  misc_feature (73)..(172): Pfam Name: K-box Pfam Description: K-box region
  misc_feature (9)..(59): Pfam Name: SRF-TF Pfam Description: SRF-type transcription factor
  misc_feature (1)..(252): Functional Homolog of  Ceres CLONE NO.241491
  misc_feature (1)..(252): useful for making plants with altered flowering time as described in USSN 12/281,616
MGRGRVEMKRIENKINRQVTFSKRRNGLLKKAYELSVLCDAEVALIIFSSRGKLYEFGSVGIESTIERYNRCYNCSLSNNKPEETTQSWCQEVTKLKSKYESLVRTNRNLLGEDLGEMGVKELQALERQLEAALTATRQRKTQVMMEEMEDLRKKERQLGDINKQLKIKFETEGHAFKTFQDLWANSAASVAGDPNNSEFPVEPSHPNVLDCNTEPFLQIGFQQHYYVQGEGSSVSKSNVAGETNFVQGWVL

SEQ ID NO: 7817 - protein, 243 aa, Malus x domestica
  misc_feature (1)..(243): Public GI ID NO.3646340
  misc_feature (69)..(171): Pfam Name: K-box Pfam Description: K-box region
  misc_feature (9)..(59): Pfam Name: SRF-TF Pfam Description: SRF-type transcription factor
  misc_feature (1)..(243): Functional Homolog of  Ceres CLONE NO.241491 with e-value of 7.69E-76 and BLAST sequence identity of 68.8
  misc_feature (1)..(243): useful for making plants with altered flowering time as described in USSN 12/281,616
MGRGRVELKRIENKINRQVTFSKRRNGLLKKAYELSVLCDAEVGLIIFSSRGKLYEFASAGMSKTLERYQRCSFTPPENSIERETQSWYQEVTKLKAKYESLQRTQRHLLGEDLGPLSVKELQNLEKQLEGALAQTRQRKTQLMIEQMEDLRKKERHLGDLNKQLRVKLEAEGQNLNVIQNMWSSDAAAGSSNFSLHSSQTNPMDCTPEPVIQMGYHQYHPAEGSSIPRSLTGETNFIQGWVL

SEQ ID NO: 7818 - protein, 253 aa, Gnetum gnemon
  misc_feature (1)..(253): Public GI ID NO.5019456
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(253): Functional Homolog of  Ceres CLONE NO.241491 with e-value of 7.70E-60 and BLAST sequence identity of 56.0
  misc_feature (1)..(253): useful for making plants with altered flowering time as described in USSN 12/281,616
MGRGRVQLRRIENKINRQVTFSKRRNGLLKKAYELSVLCDAEVALIIFSTRGKLYEFASSSMSKTLERYEKCSYSMQENASTDRDAQNWHHEVTKLKAKLESLHKAQRSLMGEDLGPLNIKELQSLEQQLEVALGHVRNRKTQLLIQTIDELRDKERTLQEVNKSLQKKLSETEGRNVIPALPHAPNGSGEWESSTLTTTTYALQTQQTSNIHHVDCEPTLHIGPYHQAVHHEAITAPPATHSEPHNQYIWWV

SEQ ID NO: 7819 - protein, 254 aa, Gnetum gnemon
  misc_feature (1)..(254): Public GI ID NO.5019460
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(254): Functional Homolog of  Ceres CLONE NO.241491 with e-value of 2.49E-63 and BLAST sequence identity of 63.9
  misc_feature (1)..(254): useful for making plants with altered flowering time as described in USSN 12/281,616
MGRGRVELKRIENKINRQVTFSKRRNGLLKKAYELSVLCDAEVALIIFSSRGKLYEFGSAGTLKTLERYQKCSYALQESNNSDRDAQTWHHEVSKLKTKVEILQRSQRHLLGEDLGPLSIRELQTLERQIEVALTQVRARKTQVMMDMMDDLKKKERLLQEVNKSLRKKLDETEGQVYSNAQLQAAPPPEWDSNAIANPVYALPPTPQNAVDCEPTCKLGIMLLLSQAFPGMIILRTTTYRGGWSNLIPDANNQ

SEQ ID NO: 7820 - protein, 252 aa, Gnetum parvifolium
  misc_feature (1)..(252): Public GI ID NO.6092009
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(252): Functional Homolog of  Ceres CLONE NO.241491 with e-value of 2.29E-60 and BLAST sequence identity of 54.1
  misc_feature (1)..(252): useful for making plants with altered flowering time as described in USSN 12/281,616
MGRGRVQLRRIENKINRQVTFSKRRNGLLKKAYELSVLCDAEVALIIFSTRGKLYEFASSSMSKTLERYEKCSYSMQENASTDRDAQNWHHEVTKLKAKLESLHKAQRNLMGEDLGPLNIKELQSLEQQLEVALGHVRNRKTQLLIQTIDELRDKERTLQEVNKSLQKKLSETEGRNVIPALPHATTGSGEWESSTLTTTYALQTQQPSGIHHVDCEPTLHIGPYHQAVHHEAIPGPPATHSEPHNQYIWWV

SEQ ID NO: 7821 - protein, 253 aa, Petunia x hybrida
  misc_feature (1)..(253): Public GI ID NO.7544096
  misc_feature (69)..(171): Pfam Name: K-box Pfam Description: K-box region
  misc_feature (9)..(59): Pfam Name: SRF-TF Pfam Description: SRF-type transcription factor
  misc_feature (1)..(253): Functional Homolog of  Ceres CLONE NO.241491 with e-value of 2.70E-73 and BLAST sequence identity of 68.6
  misc_feature (1)..(253): useful for making plants with altered flowering time as described in USSN 12/281,616
MGRGRVELKRIENKINRQVTFSKRRNGLLKKAYELSVLCDAEVALIIFSSRGKLYEFGNAGITKTLERYQRCCLNPQDNCGERETQSWYQEVSKLKGKFEALQRTQRHLLGEDLGPLSVKELQNLEKQLEGALAQARQRKTQIMMEQMEELRRKERHLGDVNKQLKVKVSLELSSLEAEGQAGLNRALPFLWTSNALEAGNSNFPVHHSQSNPMDCGPDPVLQYRDHHYMAADGPSGSRSMAVETNIMQGWGL

SEQ ID NO: 7822 - protein, 259 aa, Poa annua
  misc_feature (1)..(259): Public GI ID NO.13958339
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(259): Functional Homolog of  Ceres CLONE NO.241491 with e-value of 1.70E-101 and BLAST sequence identity of 85.2
  misc_feature (1)..(259): useful for making plants with altered flowering time as described in USSN 12/281,616
MGRGRVELKRIENKINRQVTFSKRRNGLLKKAYELSVLCDAEVALIIFSSRGKLYEFGSAGTTKTLERYQHCCYNAQDSNSALSETQSWYQEMSKLKAKFEALQRTQRHLLGEDLGPLSVKELQQLEKQLECSLSQARQRKTQLMVEQVEELRRKERQLGEINRQLKHKLDAEGSSSNNYRAMQQLTWAAGTVVDEGAAAYHMQHQQQQQPNHSAAMDCEPTLQIGYPHQFAAPEQAANNIPRSSGQGGENNFMLGWVL

SEQ ID NO: 7823 - protein, 244 aa, Vitis vinifera
  misc_feature (1)..(244): Public GI ID NO.20385586
  misc_feature (84)..(171): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.241491 with e-value of 9.19E-80 and BLAST sequence identity of 73.1
  misc_feature (1)..(244): useful for making plants with altered flowering time as described in USSN 12/281,616
MGRGRVELKRIENKINRQVTFSKRRNGLLKKAYELSVLCDAEVALIIFSSRGKLYEFGSAGTTKTLERYQRVCYTPQDNNMECETQSWYQEVSKLKAKYESLQRTQRHLLGEDLGPLSVKELQNLEKQLEGALAQARQRKTQMMIEQMEDLRRKERQLGDLNKQLKLKLEAEGQSLKAIQGSWNPSTATAGNSSFPVHPSQSNPMDCEPEPILQIGYHHYVPAEGPSVSKSMAGESNFIQGWVL

SEQ ID NO: 7824 - protein, 259 aa, Brassica oleracea var. botrytis
  misc_feature (1)..(259): Public GI ID NO.23304692
  misc_feature (73)..(172): Pfam Name: K-box Pfam Description: K-box region
  misc_feature (9)..(59): Pfam Name: SRF-TF Pfam Description: SRF-type transcription factor
  misc_feature (1)..(259): Functional Homolog of  Ceres CLONE NO.241491 with e-value of 1.29E-66 and BLAST sequence identity of 58.6
  misc_feature (1)..(259): useful for making plants with altered flowering time as described in USSN 12/281,616
MGRGRVEMKRIENKINRQVTFSKRRNGLLKKAYELSVLCDAEVALIVFSSRGKLYEFGSVGVERTIERYHRCYNCSVTNNRPEESKQNWCQEVAKLKAKYESLVRTNRHLLGEDIGEMGVKQLQALERQLEAALTATRQRKTQVMMEEMEDLRKKERQLGDINKQLKIKFEAGGHAFKSFQDFWPNSAASMAGDPNNSKFPVQPSHPDSVDCNTEPFLQIGLVLVYIRFQQHYYVQGEGSSVPKSNVACETNFVQDWFL

SEQ ID NO: 7825 - protein, 252 aa, Brassica oleracea var. botrytis
  misc_feature (1)..(252): Public GI ID NO.23304710
  misc_feature (73)..(172): Pfam Name: K-box Pfam Description: K-box region
  misc_feature (9)..(59): Pfam Name: SRF-TF Pfam Description: SRF-type transcription factor
  misc_feature (1)..(252): Functional Homolog of  Ceres CLONE NO.241491 with e-value of 7.59E-69 and BLAST sequence identity of 58.6
  misc_feature (1)..(252): useful for making plants with altered flowering time as described in USSN 12/281,616
MGRGRVEMKRIENKINRQVTFSKRRNGLLKKAYELSVLCDAEVALIVFSSRGKLYEFGSVGVERTIERYHRCYNCSVTNNRPEESKQNWCQEVAKLKAKYESLVRTNRHLLGEDIGEMGVKQLQALERQLEAALTATRQRKTQVMMEEMEDLRKKERQLGDINKQLKIKFEAGGHAFKSFQDFWPNSAASMAGDPNNSKFPVQPSHPDSVDCNTEPFLQIGFQQHYYVQGEGSSVPKSNVACETNFVQDWFL

SEQ ID NO: 7826 - protein, 250 aa, Chrysanthemum x morifolium
  misc_feature (1)..(250): Public GI ID NO.27804371
  misc_feature (74)..(171): Pfam Name: K-box Pfam Description: K-box region
  misc_feature (9)..(59): Pfam Name: SRF-TF Pfam Description: SRF-type transcription factor
  misc_feature (1)..(250): Functional Homolog of  Ceres CLONE NO.241491 with e-value of 7.59E-69 and BLAST sequence identity of 67.9
  misc_feature (1)..(250): useful for making plants with altered flowering time as described in USSN 12/281,616
MGRGRVELKRIENKINRQVTFSKRRNGLLKKAYELSVLCDAEVGLIIFSSRDKLYEFGSVGVMKTLERYQRCCFNPQDNNNERETQSWYQEVSKLKAKFESLQRTQRHLLGEDLGPLSVKELHNLEKQLEGALTQARQRKTQILVEQMEELRCKERELGDMNKHLKIKVSHELSTFETEGQGYRTHQLPCPWNSSNNNTFLMHPSQSNPMGCQQEQPILQIGDNQFMQGEGSSGQRNMVDETNIHGNWVI

SEQ ID NO: 7827 - protein, 260 aa, Lolium perenne
  misc_feature (1)..(260): Public GI ID NO.28630959
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(260): Functional Homolog of  Ceres CLONE NO.241491 with e-value of 1.19E-100 and BLAST sequence identity of 84.0
  misc_feature (1)..(260): useful for making plants with altered flowering time as described in USSN 12/281,616
MGRGRVELKRIENKINRQVTFSKRRNGLLKKAYELSVLCDAEVALIIFSSRGKLYEFGSAGTTKTLERYQHCCYNAQDSSSALSETQSWYQEMSKLKAKFEALQRTQRHLLGEDLGPLSVKELQQLEKQLECSLSQARQRKTQLMMEQVEELRRKERQLGEINRQLKHKLDAEGSSSNSFRAMQQITWAAGTVVDEGAGAYHMHHQQQPNHSAAMDCEPTLQIGYPHQFAAAEQAANNIPRSSAPGGENNFMLGWVLGAN

SEQ ID NO: 7828 - protein, 243 aa, Agapanthus praecox
  misc_feature (1)..(243): Public GI ID NO.29467050
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(243): Functional Homolog of  Ceres CLONE NO.241491 with e-value of 1.79E-83 and BLAST sequence identity of 72.0
  misc_feature (1)..(243): useful for making plants with altered flowering time as described in USSN 12/281,616
MGRGRVELKRIENKINRQVTFSKRRNGLLKKAYELSVLCDAEVALIVFSSRGKLYEFGSAGTSKTLERYQRCCYTSQDATIADREKQNWYQEVARLKAKFESLQSAQRHLLGEDLGPLSVKELQQLERQLEASLSQARQRKTQIMFDQMEELRKKEHHLGEINKQLKTKLEAEGENLRAIQGSWESDATNVGGGNVFSMHPSHSSAMECEPTLQIGYHQLVQPEGSLPRNSGGENNFMLGWVL

SEQ ID NO: 7829 - protein, 241 aa, Asparagus officinalis
  misc_feature (1)..(241): Public GI ID NO.34979582
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(241): Functional Homolog of  Ceres CLONE NO.241491 with e-value of 4.49E-87 and BLAST sequence identity of 77.1
  misc_feature (1)..(241): useful for making plants with altered flowering time as described in USSN 12/281,616
MGRGRVELKRIENKINRQVTFSKRRNGLLKKAYELSVLCDAEVALIIFSSRGKLYEFGSAGTSKTLERYQRCCYTSQDAAIASHETQSWYQEVSKLKAKFESLQRSQRHLLGEDLGPLSVKELQQLERQLESALSQARQRKTQIMLDQMEELRKKERHLGEINKQLKAKLEAEGASFRAIQGSWESEAGVGGNAFSMHPSQSSAMDCEPTLQIGYHHLVQPEAALPRSSGGENNFMLGWVL

SEQ ID NO: 7830 - protein, 249 aa, Dendrocalamus latiflorus
  misc_feature (1)..(249): Public GI ID NO.47681321
  misc_feature (74)..(171): Pfam Name: K-box Pfam Description: K-box region
  misc_feature (9)..(59): Pfam Name: SRF-TF Pfam Description: SRF-type transcription factor
  misc_feature (1)..(249): Functional Homolog of  Ceres CLONE NO.241491 with e-value of 9.39E-103 and BLAST sequence identity of 86.6
  misc_feature (1)..(249): useful for making plants with altered flowering time as described in USSN 12/281,616
MGRGNVELKRIENKINRQVTFSKRRNGLLKKAYELSVLCDAEVALIIFSSRGKLYEFGSAGISKTLERYQHCCYNAQDNNALSETQIWYQEMPKLRAKFEALQRTQRHLLGEDLGPLSVKELQQLEKQLECALSQARQRKTQLMMEQVEELRKKERQLGEINRQLKHKLEAEGSSNYRAMHQASWAPGTVVDEGAAYHVQQPPHSAALDCEPPTLQIGYPHQFMPPEAANIPGSAPAGGENNFMLGWVL

SEQ ID NO: 7831 - protein, 247 aa, Gerbera hybrida
  misc_feature (1)..(247): Public GI ID NO.50470538
  misc_feature (74)..(171): Pfam Name: K-box Pfam Description: K-box region
  misc_feature (9)..(59): Pfam Name: SRF-TF Pfam Description: SRF-type transcription factor
  misc_feature (1)..(247): Functional Homolog of  Ceres CLONE NO.241491 with e-value of 2.70E-73 and BLAST sequence identity of 69.2
  misc_feature (1)..(247): useful for making plants with altered flowering time as described in USSN 12/281,616
MGRGRVELKRIENKINRQVTFSKRRNGLLKKAYELSVLCDAEVGLIIFSSRDKLYEFGSVGVMKTLERYQRCCFNPQDNNNERETQSWYQEVSKLKAKFESLQRTQRHLLGEDLGPLSVKELHNLEKQLEGALTQARQRKTQIMVEQMEELRRKERELGDMNKHLKIKVSHELSTFDAEGQGYRAQLPCPWNSGTNNTFTMHPSQSNPMDCQQEPILQIGYNQFMHGEGSSVQRNMVGENGIHGWVL

SEQ ID NO: 7832 - protein, 242 aa, Hyacinthus orientalis
  misc_feature (1)..(242): Public GI ID NO.50919528
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(242): Functional Homolog of  Ceres CLONE NO.241491 with e-value of 5.29E-84 and BLAST sequence identity of 74.6
  misc_feature (1)..(242): useful for making plants with altered flowering time as described in USSN 12/281,616
MGRGRVELKRIENKINRQVTFSKRRNGLLKKAYELSVLCDAEVALIVFSSRGKLYEFGSAGTGKTLERYQRCCYTSQDASIADREAQSWYQEVSKLKAKFESLQRSQRHLLGEDLGPLSVKELQQLERQMESALSQARQRKQTQIMLDQMEELRKKERHLGEINKHLKSRLEAEGATFRAIQGSWESTAAIQGNAFSVHPSQSRAMDCEPTLQIGYHHLVQPEEAIPRNTVGENNFMLGWVL

SEQ ID NO: 7833 - protein, 241 aa, Elaeis guineensis
  misc_feature (1)..(241): Public GI ID NO.58201615
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(241): Functional Homolog of  Ceres CLONE NO.241491 with e-value of 3.80E-83 and BLAST sequence identity of 73.4
  misc_feature (1)..(241): useful for making plants with altered flowering time as described in USSN 12/281,616
MGRGRVELKRIENKINRQVTFSKRRSGLLKKAYELSVLCDAEIALIIFSSRGKLYEFGSVGTSKTLERYQRCCYTSQDSNFADQETQNWYQEMAKLKAKFESLQRSQRHLLGEDLGPLTVKELQQLERQLESALSQARQRKAQIMLDQMEELRKKERHLGEINKQLKDRLDAESASFRAIQGSWASDGVVTNNAFSLQPSQSNDMDCEPTLQIGFPQLVPPEAAITRNTGGENNFMLGWVL

SEQ ID NO: 7834 - protein, 244 aa, Hordeum vulgare subsp. vulgare
  misc_feature (1)..(244): Public GI ID NO.58866604
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.241491
  misc_feature (1)..(244): useful for making plants with altered flowering time as described in USSN 12/281,616
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRARKNQLMHESISELQKKERSLQEENKVLQKELVEKQKAQAAQQDQTQPQTSSSSSSFMMRDAPPVADTSNHPAAAGERAEDVAVQPQVPLRTALPLWMVSHING

SEQ ID NO: 7835 - protein, 252 aa, Ginkgo biloba
  misc_feature (1)..(252): Public GI ID NO.62122341
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(252): Functional Homolog of  Ceres CLONE NO.241491 with e-value of 1.19E-63 and BLAST sequence identity of 58.6
  misc_feature (1)..(252): useful for making plants with altered flowering time as described in USSN 12/281,616
MGRGRVQLRRIENKINRQVTFSKRRNGLLKKAYELSVLCDAEVALIVFSTRGKLYEFASSSMNKTLERYEKCSYAVQDTNVSNREAQNWHQEVTKLKSKVELLQQSQRHLLGEDLGPLSVKELQQLERQLEIALNHVRSRKSQVMMDLIDELRKKERLLQEVNKSLHKKLSESEGRNATHDMRHPTDDNGPWNPSVNGGYALPSTQQNTNLHPVDCEPTLQIGYQSVPRESIEPPQEQTHNQPQDNYTGWWV

SEQ ID NO: 7836 - protein, 243 aa, Ginkgo biloba
  misc_feature (1)..(243): Public GI ID NO.62122355
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(243): Functional Homolog of  Ceres CLONE NO.241491 with e-value of 2.40E-72 and BLAST sequence identity of 66.5
  misc_feature (1)..(243): useful for making plants with altered flowering time as described in USSN 12/281,616
MGRGRVELKRIENKINRQVTFSKRRNGLLKKAYELSVLCDAEVALIIFSSRGKVYEFGSAGMTKTLERYQKCSYVLQDVNVSDREAQNWHQEVGKLKAKVELLQRSQRHLLGEDLGPLSVKELQQLERQLEVALTHVRSRKTQVMLDLMDELRKKERLLQEVNKSLRKKLSEAEEQRAFSAMQDPGSWDSNAVANNAYAMPPNQSNAVDCEPTLQIGYQYAPPETSMPRADQTENNYMQGWMV

SEQ ID NO: 7837 - protein, 241 aa, Amborella trichopoda
  misc_feature (1)..(241): Public GI ID NO.63014399
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(241): Functional Homolog of  Ceres CLONE NO.241491 with e-value of 2.10E-80 and BLAST sequence identity of 71.3
  misc_feature (1)..(241): useful for making plants with altered flowering time as described in USSN 12/281,616
MGRGRVELKRIENKINRQVTFSKRRNGLLKKAYELSVLCDAEVGLIIFSSRGKLYEFGSAGLSKTLERYQRCCYTPQDNSATDRETQNWSQELSKLKAKYETLQRSQRHLLGEDLGPLSVKELQQLERQLEVALSQARQRKTQILMDQMEELRRKERRLGDINKQLKSKLESDGQGSFRGIQGTWESGTVVGNNAFAVNPSHANPIDCEPTLQIGYHHFVSPESIPRTGPAESNFVQGWVL

SEQ ID NO: 7838 - protein, 249 aa, Oryza sativa
  misc_feature (1)..(249): Public GI ID NO.75233139
  misc_feature (74)..(174): Pfam Name: K-box Pfam Description: K-box region
  misc_feature (9)..(59): Pfam Name: SRF-TF Pfam Description: SRF-type transcription factor
  misc_feature (1)..(249): Functional Homolog of  Ceres CLONE NO.241491 with e-value of 6.30E-81 and BLAST sequence identity of 72.2
  misc_feature (1)..(249): useful for making plants with altered flowering time as described in USSN 12/281,616
MGRGRVELKRIENKINRQVTFSKRRNGLLKKAYELSVLCDAEVALIIFSSRGKLYEFGSAGINKTLEKYNSCCYNAQGSNSALAGGEHQSWYQEMSRLKTKLECLQRSQRHMLGEDLGPLSIKELQQLEKQLEYSLSQARQRKTQIMMEQVDDLRRKERQLGELNKQLKNKLEAEADSSNCRSAIQDSWVHGTVVSGGRVLNAQPPPDIDCEPTLQIGYYQFVRPEAANPRSNGGGGDQNNNFVMGWPL

SEQ ID NO: 7839 - protein, 247 aa, Momordica charantia
  misc_feature (1)..(247): Public GI ID NO.90995184
  misc_feature (82)..(171): Pfam Name: K-box Pfam Description: K-box region
  misc_feature (9)..(59): Pfam Name: SRF-TF Pfam Description: SRF-type transcription factor
  misc_feature (1)..(247): Functional Homolog of  Ceres CLONE NO.241491 with e-value of 2.40E-72 and BLAST sequence identity of 67.3
  misc_feature (1)..(247): useful for making plants with altered flowering time as described in USSN 12/281,616
MGRGRVELKRIENKINRQVTFSKRRNGLLKKAYELSVLCDAEVALIIFSSRGKLYEFGSAGTTKTLERYQRCCFSPQDNHIERQTQSWFQEISKLKVKYESLCRTQRHLLGEDLGPLSVKELQNLEKQLEAALAQARQRKTQMMIDQMEALRRKERQLGDLNKELRLKLEAEGQNLKAIQSFWSSSSAAAGHGNDFPLHHSQASPIECQHEQPVLQIGYQNYFSAEGPSVRKSMTTCETNFIQGWVI

SEQ ID NO: 7840 - protein, 259 aa, Triticum aestivum
  misc_feature (1)..(259): Public GI ID NO.95981958
  misc_feature (74)..(172): Pfam Name: K-box Pfam Description: K-box region
  misc_feature (9)..(59): Pfam Name: SRF-TF Pfam Description: SRF-type transcription factor
  misc_feature (1)..(259): Functional Homolog of  Ceres CLONE NO.241491 with e-value of 2.60E-100 and BLAST sequence identity of 82.8
  misc_feature (1)..(259): useful for making plants with altered flowering time as described in USSN 12/281,616
MGRGRVELKRIENKINRQVTFSKRRNGLLKKAYELSVLCDAEVALIIFSSRGKLYEFGSAGTTKTLERYQHCCYNAQDSNGALSETQSWYQEMSKLKAKFEALQRTQRHLLGEDLGPLSVKELQQLEKQLECSLSLARQRKTQLMMEQVEELRRKERQLGDINRQLKHKLDAEGSNSNNYRAMQQITWAAGTVVDEGAAAYHMQQQQQQHPNHSAAMDCEPTLRIGYPHQFAAPDQAANNIPRSSAPGGENDFMLGWVL

SEQ ID NO: 7841 - DNA, 1305 bp, Zea mays; identical to SEQ ID NO: 6950
  misc_feature (1)..(1305): Ceres CLONE ID no.246416
  misc_feature (1)..(1305): useful for making plants with altered flowering time as described in USSN 12/281,616

SEQ ID NO: 7842 - protein, 251 aa, Zea mays; identical to SEQ ID NO: 6951
  misc_feature (1)..(251): Ceres CLONE ID NO.246416
  misc_feature (76)..(173): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416
  misc_feature (1)..(251): useful for making plants with altered flowering time as described in USSN 12/281,616

SEQ ID NO: 7843 - DNA, 974 bp, Oryza sativa
  misc_feature (1)..(974): Ceres ANNOT ID no.1250906
  misc_feature (1)..(974): useful for making plants with altered flowering time as described in USSN 12/281,616
catcttccccgagctctccaccctccacccgccaccgccaccgccgccttcgccgccgccgccgccgccgacgacgatggggagagggccggtgcagctgcggcggatcgagaacaagataaacaggcaggtgaccttctccaagcggaggaacgggctgctgaagaaggcgcacgagatctccgtgctctgtgacgccgacgtcgcgctcatcgtcttctccaccaagggcaagctctacgagttctccagccactccagtatggaagggatccttgaacgctaccagcgttactcgtttgatgaaagagccgtactggagccaaatactgaggaccaggaaaactggggtgatgaatatggaattttgaagtccaaactggatgcacttcagaagagccaaaggcaactcttaggtgaacaattggacacactaacaataaaagaactccagcaattggaacatcaactggaatattctctgaagcatataagatcaaaaaagaatcagcttctgtttgaatcaatttctgagcttcagaagaaggaaaagtcacttaaaaaccagaataatgttctgcaaaagctcatggagacagaaaaggagaaaaacaatgctataataaacactaaccgggaggagcaaaatggagcaacaccaagcacatcatcaccaacaccagtgacggctccagatcccatcccgacaacaaataacagtcaaagccaaccaagaggatcaggggagtcagaagctcaaccgtctccggcacaagcaggcaacagcaagcttccgccatggatgctccggacaagtcacacatgaaggcatctgttgatctcaaacgtcactccactcaatggccaacatcaacatgtttcttccaactaaggcagccactgttgtgcaatccatcttccagcgatattgatatatcggcattcggcatagccaatatatattaatgtaatgt

SEQ ID NO: 7844 - protein, 249 aa, Oryza sativa; identical to SEQ ID NO: 6953
  misc_feature (1)..(249): Ceres ANNOT ID NO.1250906
  misc_feature (75)..(173): Pfam Name: K-box Pfam Description: K-box region
  misc_feature (9)..(59): Pfam Name: SRF-TF Pfam Description: SRF-type transcription factor
  misc_feature (1)..(249): Functional Homolog of  Ceres CLONE NO.246416
  misc_feature (1)..(249): useful for making plants with altered flowering time as described in USSN 12/281,616

SEQ ID NO: 7845 - DNA, 726 bp, Populus balsamifera subsp. trichocarpa
  misc_feature (1)..(726): Ceres ANNOT ID no.1511886
  misc_feature (1)..(726): useful for making plants with altered flowering time as described in USSN 12/281,616
atgggaagaggtagggttcagttgaagagaatagagaacaagatcaaccggcaggttacattttccaaaagaagaactggattgttgaagaaagctcatgaaatctcagtcctatgtgatgccgaggttgccttgatcgtcttctctcataaagggaagctctttgaatactccaccaatgcttgcatggaaaagatacttgaacgccacgagaggtattcttatgcagagaggcaattagtcgcaactgatcttgattcgcaggggaactggaccctagagtataacaggctcaaggcaaaggttgaacttctacagagaaaccacaggcactatttgggggaagatctggactccgtgagtctcaaagagcttcaaaacttggagcaacagattgataccgcccttaaactcattcgggaaagaaaaaaccatctgatgtatcagtcgatttctgagctgcagataaaggagaaggcaattaaagagcaaaataacatgttagtgaagcagatcaaggagaaggagaaagcactggcacagccggcactctgggatcagcaagatcatggccctaatgcttcctcattccttttaccacagccgccactgccttgtttaaacatcagttaccaggaagaagatccagaagcgaggaggaattatgaacttgacctcacgctggaaccaatttattcgtgtcaccttggatgctttggaacatga

SEQ ID NO: 7846 - protein, 241 aa, Populus balsamifera subsp. trichocarpa
  misc_feature (1)..(241): Ceres ANNOT ID NO.1511886
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(241): Functional Homolog of  Ceres CLONE NO.246416
  misc_feature (1)..(241): useful for making plants with altered flowering time as described in USSN 12/281,616
MGRGRVQLKRIENKINRQVTFSKRRTGLLKKAHEISVLCDAEVALIVFSHKGKLFEYSTNACMEKILERHERYSYAERQLVATDLDSQGNWTLEYNRLKAKVELLQRNHRHYLGEDLDSVSLKELQNLEQQIDTALKLIRERKNHLMYQSISELQIKEKAIKEQNNMLVKQIKEKEKALAQPALWDQQDHGPNASSFLLPQPPLPCLNISYQEEDPEARRNYELDLTLEPIYSCHLGCFGT

SEQ ID NO: 7847 - DNA, 747 bp, Populus balsamifera subsp. trichocarpa
  misc_feature (1)..(747): Ceres ANNOT ID no.1517635
  misc_feature (1)..(747): useful for making plants with altered flowering time as described in USSN 12/281,616
atgggaagaggtagggttcagttgaagagaatagagaacaagatcaaccggcaggtaacattttccaaaaggagaactggattgttgaagaaagctaatgaaatctcagtcctgtgtgacgctgaggttgctttgattgtcttctctcacaaagggaagctctttgaatactccacagatgattccatggaaaagatacttgaacgctacgagagatattcttatgcagagaggcaactagttgccactgatcttgattcacaggggaactggaccctggagtataacaggctcaaggcaaaggttgaacttctacagagaaaccataggaactatttgggggaggatctagactccatgagtctcaaagagctacagaacttagagcaacagattgataccgcccttaaacacattcgggcgagaaaaaaccatctgatgagtcagtcgatttctgagctgcagagaaaggagaaggcaattcaagtgcaaaacaacatgttagtgaagcagatcaaggagaaggagaagaatgataaagcgctggcacagccggcattctgggatctgcaagatcatggccctaatgcttcctcattccttttatcacagccggcaggcctgccactgccttgcttaaacatcggtggcagtcaccaggaagaagctcctgaagcgaggaggaatgagcttggccatacgctggaaccaatttattcttttcaccttggaggttacggagcatga

SEQ ID NO: 7848 - protein, 248 aa, Populus balsamifera subsp. trichocarpa
  misc_feature (1)..(248): Ceres ANNOT ID NO.1517635
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(248): Functional Homolog of  Ceres CLONE NO.246416
  misc_feature (1)..(248): useful for making plants with altered flowering time as described in USSN 12/281,616
MGRGRVQLKRIENKINRQVTFSKRRTGLLKKANEISVLCDAEVALIVFSHKGKLFEYSTDDSMEKILERYERYSYAERQLVATDLDSQGNWTLEYNRLKAKVELLQRNHRNYLGEDLDSMSLKELQNLEQQIDTALKHIRARKNHLMSQSISELQRKEKAIQVQNNMLVKQIKEKEKNDKALAQPAFWDLQDHGPNASSFLLSQPAGLPLPCLNIGGSHQEEAPEARRNELGHTLEPIYSFHLGGYGA

SEQ ID NO: 7849 - DNA, 1165 bp, Arabidopsis thaliana
  misc_feature (1)..(1165): Ceres CLONE ID no.39890
  misc_feature (1)..(1165): Ceres LOCUS ID At1g69120
  misc_feature (1)..(1165): useful for making plants with altered flowering time as described in USSN 12/281,616
aagtctttttataaaggaaagaaagaaaaactttcctaattggttcataccaaagtctgagctcttctttatatctctcttgtagtttcttattgggggtctttgttttgtttggttcttttagagtaagaagtttcttaaaaaaggatcaaaaatgggaaggggtagggttcaattgaagaggatagagaacaagatcaatagacaagtgacattctcgaaaagaagagctggtcttttgaagaaagctcatgagatctctgttctctgtgatgctgaagttgctcttgttgtcttctcccataaggggaaactcttcgaatactccactgattcttgtatggagaagatacttgaacgctatgagaggtactcttacgccgaaagacagcttattgcacctgagtccgacgtcaatacaaactggtcgatggagtataacaggcttaaggctaagattgagcttttggagagaaaccagaggcattatcttggggaagacttgcaagcaatgagccctaaagagcttcagaatctggagcagcagcttgacactgctcttaagcacatccgcactagaaaaaaccaacttatgtacgagtccatcaatgagctccaaaaaaaggagaaggccatacaggagcaaaacagcatgctttctaaacagatcaaggagagggaaaaaattcttagggctcaacaggagcagtgggatcagcataaccaaggccacaatatgcctccccctctgccaccgcagcagcaccaaatccagcatccttacatgctctctcatcagccatctccttttctcaacatgggtggtctgtatcaagaagatgatccaatggcaatgaggaggaatgatctcgaactgactcttgaacccgtttacaactgcaaccttggctgcttcgccgcatgaagcatttccatatatatatttgtaatcgtcaacaataaaaacagtttgccacatacatataaatagtggctaggctcttttcatccaattaatatattttggcaaatgttcgatgttcttatatcatcatatataaattagcaggctcctttcttcttttgtaatttgataagtttatttgcttcaatatggagcaaaattgtaatatatttgaaggtcagagagaatgaacgtgaactt

SEQ ID NO: 7850 - protein, 256 aa, Arabidopsis thaliana
  misc_feature (1)..(256): Ceres CLONE ID NO.39890
  misc_feature (1)..(256): Ceres LOCUS ID At1g69120
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(256): Functional Homolog of  Ceres CLONE NO.246416
  misc_feature (1)..(256): useful for making plants with altered flowering time as described in USSN 12/281,616
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQHNQGHNMPPPLPPQQHQIQHPYMLSHQPSPFLNMGGLYQEDDPMAMRRNDLELTLEPVYNCNLGCFAA

SEQ ID NO: 7851 - DNA, 1224 bp, Glycine max
  misc_feature (1)..(1224): Ceres CLONE ID no.467075
  misc_feature (1)..(1224): useful for making plants with altered flowering time as described in USSN 12/281,616
gacagaaagaagaaccaccaagaaagaagcataggggaaaatacatcgatagagagaaattgaagggtgctacgtccttctattgtattaatgattgaaattcgtgtgggaattgtcttgttggtgtggtagagataataagagaggatcatagtagtgctagaaattgaagtgtgtaatagaatagtgatagagagagagagatatggggagaggaagggtgcagttgaagaggatcgagaacaagatcaataggcaagtgacgttctcaaagagaaggtctggtttgctcaagaaagcacatgagatctctgtgcattgtgatgctgaagtggccctcatagtcttctccaccaaaggcaaactctttgagtactccagcgatccctgtatggaaaaaattcttgaacggtatgagaggtattcatatgcagagaggcagcttgttgcaagtgatcaaccactaactgaaaattggactctggaacatgcaaagctgaaagcaaggttggaagtcctacagaaaaatcaaagggtttgcctgttattttgcaggaattttatgggacaagatttggagggcctaagtatcaaagagcttcagaatttggagcatcagcttgaaagtgctctcaaacacattagatcacggaagaaccaactgatgtatgaatctatttcagagcttcataaaaaggataaggccctacaagaacaaaacaacactctcgctaagaagataaaggagaaagagaaggcactagcccaacaggcacaactggagcgacttggtgatgaagtggatctgacttcctctgcccttgttccccaaccactggtgacatcaaacattagaacctcctcacaaatcagaggtgaaggagataacgaaggaaccccaactccaacccaagctaatgccattcttccaccttggatgcttcgtcctacaaatgaatagaatactatttaattaatgacataaagttttaatcaaattaaatatgaatatggccaatacaaagctcaccctacaagatgtaaaatggtctagtgtgttgatttgggaatggcacccggtgacttgatcagttggaatatcaacgatatgtaatatgtctgtgactaccacatttcaaggatgcttagtaaattatatggtatggcctgtctatacaggcctacaatacatatatagtgtcaattaaaaaaaaaaaaaaaaaa

SEQ ID NO: 7852 - protein, 251 aa, Glycine max
  misc_feature (1)..(251): Ceres CLONE ID NO.467075
  misc_feature (75)..(181): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416
  misc_feature (1)..(251): useful for making plants with altered flowering time as described in USSN 12/281,616
MGRGRVQLKRIENKINRQVTFSKRRSGLLKKAHEISVHCDAEVALIVFSTKGKLFEYSSDPCMEKILERYERYSYAERQLVASDQPLTENWTLEHAKLKARLEVLQKNQRVCLLFCRNFMGQDLEGLSIKELQNLEHQLESALKHIRSRKNQLMYESISELHKKDKALQEQNNTLAKKIKEKEKALAQQAQLERLGDEVDLTSSALVPQPLVTSNIRTSSQIRGEGDNEGTPTPTQANAILPPWMLRPTNE

SEQ ID NO: 7853 - DNA, 1241 bp, Glycine max
  misc_feature (1)..(1241): Ceres CLONE ID no.480529
  misc_feature (1)..(1241): useful for making plants with altered flowering time as described in USSN 12/281,616
tattaatgattgaaattcgtgtgggaattgtcttgttggtgtggtagagataataagagaggatcatagtagtgctagaaattgaagtgtgtaatagaatagtgatagagagagagagatatggggagaggaagggtgcagttgaagaggatcgagaacaagatcaataggcaagtgacgttctcaaagagaaggtctggtttgctcamgaaagcacatgagatctctgtgcmttgtgatgctgaagtggccctcatagtcttctccaccaaaggcaaactctttgagtactccagcgatccctgtatggaaaaaattcttgaacggtatgagaggtattcatatgcasagaggcagcttgttgcaagtgatcaaccactaactgaaaattggactctggaacatgcaaagctgaaagcaaggttggaagtcctacagaaaaatcaaaggaattttatggsacaagatttggagggcctaagtwtcaaasagcttcagaatttggagcatcagcttgaaagtgctctcaaacacattagatcacggaagaaccaactgatgtatgaatctatttcagagcttcataaaaaggataaggccctacaagaacaaaacaacactctcgctaagaagataaaggagaaagagaaggcactagcccaacaggcacaactggagcgacttggtgatgaagtggatctgacttcctctgcccttgttccccaaccactggtgacatcaaacattagaacctcctcacaaatcagaggtgaaggagataacgaaggaaccccaactccaacccaagctaatgccattcttccaccttggatgcttcgtcctacaaatgaatagaatactatttaattaatgacataaagttttaatcaaattaaatatgaatatggccaatacaaagctcaccctacaagatgtaaaatggtctagtgtgttgatttgggaatggcacccggtgacttgatcagttggaatatcaacgatatgtaatatgtctgtgactaccacatttcaaggatgcttagtaaattatatggtatggcctgtctatacaggcctacaatacatatatagtgtcaattatgtatgtttggttcttatcaaaagtttaagttgtgctagaaactacgatattgggcgatgttagatccctcaaaatctatgattttttacaacagaaatattaaattttgtatgaactaatggttttatctaagtgttac

SEQ ID NO: 7854 - protein, 244 aa, Glycine max
  misc_feature (1)..(244): Ceres CLONE ID NO.480529
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.246416
  misc_feature (30)..(30): Xaa is any aa, unknown, or other
  misc_feature (38)..(38): Xaa is any aa, unknown, or other
  misc_feature (77)..(77): Xaa is any aa, unknown, or other
  misc_feature (114)..(114): Xaa is any aa, unknown, or other
  misc_feature (124)..(124): Xaa is any aa, unknown, or other
  misc_feature (1)..(244): useful for making plants with altered flowering time as described in USSN 12/281,616
MGRGRVQLKRIENKINRQVTFSKRRSGLLXKAHEISVXCDAEVALIVFSTKGKLFEYSSDPCMEKILERYERYSYAXRQLVASDQPLTENWTLEHAKLKARLEVLQKNQRNFMXQDLEGLSIKXLQNLEHQLESALKHIRSRKNQLMYESISELHKKDKALQEQNNTLAKKIKEKEKALAQQAQLERLGDEVDLTSSALVPQPLVTSNIRTSSQIRGEGDNEGTPTPTQANAILPPWMLRPTNE

SEQ ID NO: 7855 - DNA, 1251 bp, Glycine max
  misc_feature (1)..(1251): Ceres CLONE ID no.515898
  misc_feature (1)..(1251): useful for making plants with altered flowering time as described in USSN 12/281,616
gacgtacataaatataaagatgttgatagcatattataaatcatagagttcattccatacacagaaagaagaacaacactaagaaagcagaatagggaaaaatacatcgatagaggaaaattaattgaagggtgctactactacgaccttctatatcattaatgattgaaattcgtgttggaattgtcttgtaggtgtagtagtgataataagagaggatcatatatatattagtagtgctagaaattaattgaagtgtgtaatagaatagagtgtgatagagagagatatggggagaggaagggtgcagttgaagaggatcgagaacaagatcaataggcaagtgacgttttcaaagagaaggtctggtttgctcaagaaagcacatgagatctctgtgctttgtgatgctgaagtggccctcatagtcttctccaccaaaggcaaactctttgagtactccagcgatccatgtatggaaagaattcttgaacggtatgagaggtattcatatgcagagaggcagcttgttgcaagtgatcaaccacaaactgaaaattggactctagaacatgcaaagctcaaagcaaggttggaagtcctacagaaaaatcaaaggaattttatgggacaagatttggagggcctaagtatcaaagagcttcaaaatttggaacatcaacttgatagtgctctaaaacacattagatcacggaagaaccaaatcatgcatgaatctatttcagagcttcataaaaaggataaggtcctacaggaacaaaataacactctcgcaaagaagataaaggagaaagagaaggcactagcccagcatgcacaaatggagcagcgtggtgatgaaatggatcttacttcctctgccctagtacctcatccattggagacatcaaacattagagagtcctcacaaataaggggtgaaggagataatgaaggaaccccaactccaacccgagcaaatgccattcttccatcttggatgcttcgtccttcaaatgaatagaagagtattaacgacctaaaattttaaattacatatgaatatggcgaatacaaagcttaccctataagatgtaaaatggtctatgtgttgaattgtgaacaccacccaatgagttcaattggaatatcatagatatgtaatgtgtctctgactactacatttcaaggatgctaagtaaattatatggtatggcctgtctaaaaaaaaaaaaaaaaaaaaaaaaaaaa

SEQ ID NO: 7856 - protein, 244 aa, Glycine max
  misc_feature (1)..(244): Ceres CLONE ID NO.515898
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.246416
  misc_feature (1)..(244): useful for making plants with altered flowering time as described in USSN 12/281,616
MGRGRVQLKRIENKINRQVTFSKRRSGLLKKAHEISVLCDAEVALIVFSTKGKLFEYSSDPCMERILERYERYSYAERQLVASDQPQTENWTLEHAKLKARLEVLQKNQRNFMGQDLEGLSIKELQNLEHQLDSALKHIRSRKNQIMHESISELHKKDKVLQEQNNTLAKKIKEKEKALAQHAQMEQRGDEMDLTSSALVPHPLETSNIRESSQIRGEGDNEGTPTPTRANAILPSWMLRPSNE

SEQ ID NO: 7857 - DNA, 1369 bp, Triticum aestivum
  misc_feature (1)..(1369): Ceres CLONE ID no.751467
  misc_feature (1)..(1369): useful for making plants with altered flowering time as described in USSN 12/281,616
attccctgcgagctccacacagcatcacaccgcatttctcattcttcctccccacgtcgccgtagcagctagctagccggggagggaggggccgccgccgccgagtgagggagccgggggaggcgggttggaggcaggccggagatggggcgcgggccggtgcagctgcggcggatcgagaacaagataaaccggcaggtgaccttctccaagcgccgcagcgggttgctgaagaaggcgcacgagatctccgtgctctgcgacgccgaggtcgcgctcatcgtcttctccaccaagggcaagctatacgagtactccagccaggacagtagcatggatgtgattcttgaacgttaccaacgttactcatttgaagaaagagctgtactggatccaagtattggaaaccaggcaaactggggagatgaatatggaagtttgaagataaaactcgatgcactccagaagagtcaaaggcaactcttgggtgaacaattggacccactcaccacaaaagaactccaacagttggaacaacagcttgatagttctttgaagcacataaggtcaagaaagaatcaacttctctttgagtctatatctgagcttcaaaagaaggagaagtcattaaaagatcagaatggtgtcctgcagaagcacctcgtagagacagaaaaggagaaaaataacgttttgtcaaatattcatcaccaagagcagttgaatggagcaacaaatattcatcaccaggagcagctgaatggagcaacaacaagctcaccgtcacctacaccagcgacagcccaagattccatggcacctccaaatattgggccatatcaatctagagaatcaggaggggggaatccagaacctcagccgtctccagcacaagcaaacaacagcaatctaccagcgtggatgctccgcaccgtcagcaacagatgaaggctggcgacagcctcatatgactccacctgaaggcgagaatggcgcctgacatgcgcccactatggaagctagacgccggtgtgcagtccatctccggcaatggcttccggtgtagccactaataagaccacgcgtctttgctgctgggtgaatggggtcttcctgtcttaagcttttcctgcactataagatacttgtttccacgtttcggttccattttttctcctatcgatgagcacgatcttgtggttggagtttcgtgtgtaacctttaatggagttgcggtatgtttttacgtgttgtgacggtttttgtattccatccgttgtaaaaaaagcaaagggcgctgccttctctttacattgttattaaaaaaaaagagcagggcactgaacttttgacaaaaaaaaaaaaaaaa

SEQ ID NO: 7858 - protein, 267 aa, Triticum aestivum
  misc_feature (1)..(267): Ceres CLONE ID NO.751467
  misc_feature (76)..(175): Pfam Name: K-box Pfam Description: K-box region
  misc_feature (9)..(59): Pfam Name: SRF-TF Pfam Description: SRF-type transcription factor
  misc_feature (1)..(267): Functional Homolog of  Ceres CLONE NO.246416
  misc_feature (1)..(267): useful for making plants with altered flowering time as described in USSN 12/281,616
MGRGPVQLRRIENKINRQVTFSKRRSGLLKKAHEISVLCDAEVALIVFSTKGKLYEYSSQDSSMDVILERYQRYSFEERAVLDPSIGNQANWGDEYGSLKIKLDALQKSQRQLLGEQLDPLTTKELQQLEQQLDSSLKHIRSRKNQLLFESISELQKKEKSLKDQNGVLQKHLVETEKEKNNVLSNIHHQEQLNGATNIHHQEQLNGATTSSPSPTPATAQDSMAPPNIGPYQSRESGGGNPEPQPSPAQANNSNLPAWMLRTVSNR

SEQ ID NO: 7859 - DNA, 1299 bp, Panicum virgatum
  misc_feature (1)..(1299): Ceres CLONE ID no.1757409
  misc_feature (1)..(1299): useful for making plants with altered flowering time as described in USSN 12/281,616
ctattcattccccgcgcaccactcgagtcgagagccacctgatccttcgttccccgtcttcctctcccccggcacgtcgctgtcgccattgccgcgccgctcgagagcggaagggggtaggtggggaagcggcggggatggggcgcgggccggtgcagctgcggcggatcgagaacaagatcaaccgccaggtgaccttctccaagcgccggaacgggctgctgaagaaggcgcacgagatctccgtgctctgcgacgccgaggtcgcgctcatcgtcttctccaccaaggggaggctctacgagtactccagcaatgacagcatggaaggcattcttgagcgttaccaacgatactcgtttgaagaaagagcagtacttgatccaaatattggagaccaggcaaactggggagatgaatatggctggttaaagaccaaacttgatgcacttcagaagagtcagaggcaactgttaggagaacaactggattcacttaccgtaaaagaactccagcaactggagcaacaactggacagctctctgaagcatataagatcaagaaagaatcagctcatgtttgattcaatttctgagcttcagaaaaaggagaaatcacttacagatcaaaatggtgtcctgcaaaagctcatggaggcagagaaagagaaaaacaatgcattaatgaatgcacacctccgggagcagcaaaatggagcatcaacaagcttgccatcaccaccgccatcaacagttccagattccatgccaactctaaatattaggccgcgtcaacctagagaaggaacagtaggggagtctgaacctgaatcgtctcctgctcaagtgaacagcggcaagctgcctccatggatgctacgcagtgtcagtaacagatgagctgttcctgatacggttctgcggctgaactcggatggcaaacacaccgtcaccaacacccttcggtgacccaggcatccataccggctcgatccagtagatgccagcatagtcactaataataagatcaggtatcaagtgctttacagggtgaataaagtctgaagctcctctgcaccatcatattgcgttttgttctcgcgtctgctgtctacctttttttttttctccgatcgacaagctcgtggttggagatgtatgctgtatcatgtttttcgtgtttacacttttacgaaaacagaaggctcttctcctggtaagggttgagtcccgatcaaagtgtcaaatgcgtaattcggtatcttagcagtattaacagcaaaaaaaaaaaaaaaaaaaa

SEQ ID NO: 7860 - protein, 253 aa, Panicum virgatum
  misc_feature (1)..(253): Ceres CLONE ID NO.1757409
  misc_feature (1)..(253): Functional Homolog of  Ceres CLONE NO.246416
  misc_feature (1)..(253): useful for making plants with altered flowering time as described in USSN 12/281,616
MGRGPVQLRRIENKINRQVTFSKRRNGLLKKAHEISVLCDAEVALIVFSTKGRLYEYSSNDSMEGILERYQRYSFEERAVLDPNIGDQANWGDEYGWLKTKLDALQKSQRQLLGEQLDSLTVKELQQLEQQLDSSLKHIRSRKNQLMFDSISELQKKEKSLTDQNGVLQKLMEAEKEKNNALMNAHLREQQNGASTSLPSPPPSTVPDSMPTLNIRPRQPREGTVGESEPESSPAQVNSGKLPPWMLRSVSNR

SEQ ID NO: 7861 - protein, 265 aa, Hordeum vulgare subsp. vulgare; identical to SEQ ID NO: 6952
  misc_feature (1)..(265): Public GI ID NO.9367307
  misc_feature (76)..(175): Pfam Name: K-box Pfam Description: K-box region
  misc_feature (9)..(59): Pfam Name: SRF-TF Pfam Description: SRF-type transcription factor
  misc_feature (1)..(265): Functional Homolog of  Ceres CLONE NO.246416
  misc_feature (1)..(265): useful for making plants with altered flowering time as described in USSN 12/281,616

SEQ ID NO: 7862 - protein, 249 aa, Oryza sativa; identical to SEQ ID NO: 6953
  misc_feature (1)..(249): Public GI ID NO.50939129
  misc_feature (75)..(173): Pfam Name: K-box Pfam Description: K-box region
  misc_feature (9)..(59): Pfam Name: SRF-TF Pfam Description: SRF-type transcription factor
  misc_feature (1)..(249): Functional Homolog of  Ceres CLONE NO.246416
  misc_feature (1)..(249): useful for making plants with altered flowering time as described in USSN 12/281,616

SEQ ID NO: 7863 - protein, 244 aa, Triticum aestivum
  misc_feature (1)..(244): Public GI ID NO.58422998
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.246416
  misc_feature (1)..(244): useful for making plants with altered flowering time as described in USSN 12/281,616
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAHVAQQDQTQPQTSSSSSSFMLRDAPPAANTSIHPAATGERAEDAAVQPQAPPRTGLPPWMVSHING

SEQ ID NO: 7864 - protein, 255 aa, Arabidopsis thaliana
  misc_feature (1)..(255): Public GI ID NO.16162
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(255): Functional Homolog of  Ceres CLONE NO.246416
  misc_feature (1)..(255): useful for making plants with altered flowering time as described in USSN 12/281,616
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRNDLELTLEPVYNCNLGCFAA

SEQ ID NO: 7865 - protein, 244 aa, Betula pendula; identical to SEQ ID NO: 6958
  misc_feature (1)..(244): Public GI ID NO.1483232
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.246416
  misc_feature (1)..(244): useful for making plants with altered flowering time as described in USSN 12/281,616

SEQ ID NO: 7866 - protein, 254 aa, Sinapis alba
  misc_feature (1)..(254): Public GI ID NO.4416347
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(254): Functional Homolog of  Ceres CLONE NO.246416
  misc_feature (1)..(254): useful for making plants with altered flowering time as described in USSN 12/281,616
MGRGRVQLKRIENKINRQVTFSKRRAGLMKKAHEISVLCDAEVALVVFSHKGKLFEYSTDSCMEKILERYERYSYAERQLIAPESDSNTNWSMEYNRLKAKIELLERNQRHYLGEDLQAMSPKELQNLEQQLDTALKHIRSRKNQLMYDSINELQRKEKAIQEQNSMLSKQIKEREKVLRAQQEQWDEQNHGHNMPPPPPLQQQIQHPYMLSHQPSPFLNMGGLYQEDQIAMRRNDLDLSLEPVYNCNLGCFAA

SEQ ID NO: 7867 - protein, 249 aa, Oryza sativa; identical to SEQ ID NO: 6954
  misc_feature (1)..(249): Public GI ID NO.6175371
  misc_feature (75)..(173): Pfam Name: K-box Pfam Description: K-box region
  misc_feature (9)..(59): Pfam Name: SRF-TF Pfam Description: SRF-type transcription factor
  misc_feature (1)..(249): Functional Homolog of  Ceres CLONE NO.246416
  misc_feature (1)..(249): useful for making plants with altered flowering time as described in USSN 12/281,616

SEQ ID NO: 7868 - protein, 247 aa, Dendrobium grex Madame Thong-In; identical to SEQ ID NO: 6957
  misc_feature (1)..(247): Public GI ID NO.6467974
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(247): Functional Homolog of  Ceres CLONE NO.246416
  misc_feature (1)..(247): useful for making plants with altered flowering time as described in USSN 12/281,616

SEQ ID NO: 7869 - protein, 248 aa, Helianthus annuus
  misc_feature (1)..(248): Public GI ID NO.18996775
  misc_feature (75)..(173): Pfam Name: K-box Pfam Description: K-box region
  misc_feature (9)..(59): Pfam Name: SRF-TF Pfam Description: SRF-type transcription factor
  misc_feature (1)..(248): Functional Homolog of  Ceres CLONE NO.246416
  misc_feature (1)..(248): useful for making plants with altered flowering time as described in USSN 12/281,616
MGRGKVQLRRIENKINRQVTFSKRRGGLLKKAHEISVLCDAEVALIVFSNKGKLFEFSTDSCMDSILERYERYSYTERQLVAADATPRSWTLEYNKLKSRAELLQRNHRHYMGEDIESLSLKEIQNLEQQLDTGLKNIRTRKNQLLHESISELQKKGKAIQEQNTTLTKKIKEKEKDKTIPQNTQWEMHNYVDHDTTFLMPPPPPALNMGGDYNHGGGGSSEGADGRTNELDLSLQPIYSCHMRCFPS

SEQ ID NO: 7870 - protein, 251 aa, Arabidopsis thaliana
  misc_feature (1)..(251): Public GI ID NO.20799346
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416
  misc_feature (1)..(251): useful for making plants with altered flowering time as described in USSN 12/281,616
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMVMRRNDLELTLEPVYNCNL

SEQ ID NO: 7871 - protein, 251 aa, Arabidopsis thaliana
  misc_feature (1)..(251): Public GI ID NO.20799348
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416
  misc_feature (1)..(251): useful for making plants with altered flowering time as described in USSN 12/281,616
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAVSPKELQNLEQQLDTALKHIRTRKNQLMYESINELQKKEKAIQEQNGMLSKQIKEREKILRAQQEQWDQQNQGHNMPPPLPPQQHQIQHPYMLSHQPSPFLNMGGLYQEDDPMAMRRNDLELTLEPVYNCNL

SEQ ID NO: 7872 - protein, 251 aa, Arabidopsis thaliana
  misc_feature (1)..(251): Public GI ID NO.20799358
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416
  misc_feature (1)..(251): useful for making plants with altered flowering time as described in USSN 12/281,616
MGRGRVQLKRIENKINRQVTFSKRRAGLLKKAHEISVLCDAEVALVVFSHKGKLFEYSTDSCMEKILERYERYSYAERQLIAPESDVNTNWSTEYNRLKAKIELLERNQRHYLGEDLQAMSPKEPQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNL

SEQ ID NO: 7873 - protein, 251 aa, Arabidopsis thaliana
  misc_feature (1)..(251): Public GI ID NO.20799362
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416
  misc_feature (1)..(251): useful for making plants with altered flowering time as described in USSN 12/281,616
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQGQWDQQNQGHNMPPPLPPQQHQIQHPYMLSHQPSPFLNMGGLYQEDDPMAMRRNDLELTLEPVYNCNL

SEQ ID NO: 7874 - protein, 251 aa, Arabidopsis thaliana
  misc_feature (1)..(251): Public GI ID NO.20799364
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416
  misc_feature (1)..(251): useful for making plants with altered flowering time as described in USSN 12/281,616
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKTKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNL

SEQ ID NO: 7875 - protein, 251 aa, Arabidopsis thaliana
  misc_feature (1)..(251): Public GI ID NO.20799368
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416
  misc_feature (1)..(251): useful for making plants with altered flowering time as described in USSN 12/281,616
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNL

SEQ ID NO: 7876 - protein, 251 aa, Arabidopsis lyrata
  misc_feature (1)..(251): Public GI ID NO.20799370
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(251): Functional Homolog of  Ceres CLONE NO.246416
  misc_feature (1)..(251): useful for making plants with altered flowering time as described in USSN 12/281,616
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLNAMSPKELQNLEQQLDTALKNIRTRKNQLMYESINELQRKEKAIQEQNSMLSKQIKEREKILRAQQEQWDQQNHGHNMPPPPPPQQHQIQHPYMLSHQPSPFLNMGGLYQEEDPMAMRRNELELTLEPVYNCNL

SEQ ID NO: 7877 - protein, 256 aa, Arabidopsis thaliana; identical to SEQ ID NO: 7850
  misc_feature (1)..(256): Public GI ID NO.21593537
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(256): Functional Homolog of  Ceres CLONE NO.246416
  misc_feature (1)..(256): useful for making plants with altered flowering time as described in USSN 12/281,616

SEQ ID NO: 7878 - protein, 242 aa, Daucus carota subsp. sativus
  misc_feature (1)..(242): Public GI ID NO.22091473
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(242): Functional Homolog of  Ceres CLONE NO.246416
  misc_feature (1)..(242): useful for making plants with altered flowering time as described in USSN 12/281,616
MGRGKVQLKRIENKINRQVTFSKRRGGLLKKAHEISVLCDAEVALIVFSNKGKLFEYSTDSSMEEILERYERYSYAERQVIANDPESTGNWTLEYTKLKARIDLLQRDHRHYMGEDLDSLTLKEIQNLEQQLDTALKHIRSRKNQLIFESISDLQKKEKAIQEENGKLTKKIKEREKTMVQQAQWEKQNPSPNLSTFLMPQENPFLNIGGTFQGESSQGMTRNDLDLTLEPNHYPCNLRCFA

SEQ ID NO: 7879 - protein, 240 aa, Populus tremuloides
  misc_feature (1)..(240): Public GI ID NO.28381537
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(240): Functional Homolog of  Ceres CLONE NO.246416
  misc_feature (1)..(240): useful for making plants with altered flowering time as described in USSN 12/281,616
MGRGRVQLKRIENKINRQVTFSKRRAGLLKKAHEISVLCDAEVALIVFCHKGKLFEYSTNACMEKILERHERYSYAERQLVATDLDSQGNWTLEYNRLKEKVELLQRNHRHYLGEDLDSVSLKELQNLEKQIDTALELIRERKNHLMYQSISELQIKEKAIKEQNNMLVKQIKEKEKALAQPALWDQQDHGPNASSFLLPQPPLPCLNISYQEEDPIARRNELDLTLEPIYSCHLGCFGT

SEQ ID NO: 7880 - protein, 279 aa, Lolium perenne
  misc_feature (1)..(279): Public GI ID NO.28630957
  misc_feature (76)..(175): Pfam Name: K-box Pfam Description: K-box region
  misc_feature (9)..(59): Pfam Name: SRF-TF Pfam Description: SRF-type transcription factor
  misc_feature (1)..(279): Functional Homolog of  Ceres CLONE NO.246416
  misc_feature (1)..(279): useful for making plants with altered flowering time as described in USSN 12/281,616
MGRGPVQLRRIENKINRQVTFSKRRSGLLKKAHEISVLCDAEVALIVFSTKGKLYEYSSQDSNMDVILERYQRYSFEERAIVDQNIGGQANWGDEFGSLKIKLDALQKSQRQLLGEQLDPLTTKELQQLEQQLDSSLKHIRSRKNQLLFESISELQKKEKSLKDQNGVLQKHLVETEKEKSNVLSNIHHREQTNGAANIHRREQMNETTHIHNQEQLNGATTSSPSPTPVAVLDSVATLNIGSSQSREAAGEEPESQPSPAQANSGKLPPWMLRTISNR

SEQ ID NO: 7881 - protein, 256 aa, Arabidopsis thaliana
  misc_feature (1)..(256): Public GI ID NO.28827280
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(256): Functional Homolog of  Ceres CLONE NO.246416
  misc_feature (1)..(256): useful for making plants with altered flowering time as described in USSN 12/281,616
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNLGCFAA

SEQ ID NO: 7882 - protein, 244 aa, Triticum monococcum; identical to SEQ ID NO: 6960
  misc_feature (1)..(244): Public GI ID NO.30090030
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.246416
  misc_feature (1)..(244): useful for making plants with altered flowering time as described in USSN 12/281,616

SEQ ID NO: 7883 - protein, 250 aa, Elaeis guineensis; identical to SEQ ID NO: 6956
  misc_feature (1)..(250): Public GI ID NO.33309864
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(250): Functional Homolog of  Ceres CLONE NO.246416
  misc_feature (1)..(250): useful for making plants with altered flowering time as described in USSN 12/281,616

SEQ ID NO: 7884 - protein, 243 aa, Citrus sinensis
  misc_feature (1)..(243): Public GI ID NO.37703726
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(243): Functional Homolog of  Ceres CLONE NO.246416
  misc_feature (1)..(243): useful for making plants with altered flowering time as described in USSN 12/281,616
MGRGRVQLKRIENKINRQVTFSKRRAGFLKKAHEISVLCDAEVAVIIFSHKGKLFEYSTGSCMEKILERYERYAYAERQLIAPDPESQRNWPLECNNLKAKIDLLQKDQRHYLGEDLESLSLKDIQQLEQQLDTALKHIRSRKNQLMQESISELQKKEKSIEEQNNLLVKQIKEREKAAAQQAQWGNQIQNQVPNTLSFLLPQPPPCLRLGGAYQEQASEMRRNELNLTLEPVCSCSLGCFAG

SEQ ID NO: 7885 - protein, 241 aa, Populus balsamifera subsp. trichocarpa; identical to SEQ ID NO: 7846
  misc_feature (1)..(241): Public GI ID NO.47934197
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(241): Functional Homolog of  Ceres CLONE NO.246416
  misc_feature (1)..(241): useful for making plants with altered flowering time as described in USSN 12/281,616

SEQ ID NO: 7886 - protein, 248 aa, Populus balsamifera subsp. trichocarpa; identical to SEQ ID NO: 7848
  misc_feature (1)..(248): Public GI ID NO.47934201
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(248): Functional Homolog of  Ceres CLONE NO.246416
  misc_feature (1)..(248): useful for making plants with altered flowering time as described in USSN 12/281,616

SEQ ID NO: 7887 - protein, 256 aa, Arabidopsis thaliana
  misc_feature (1)..(256): Public GI ID NO.51970008
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(256): Functional Homolog of  Ceres CLONE NO.246416
  misc_feature (1)..(256): useful for making plants with altered flowering time as described in USSN 12/281,616
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHMRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNLGCFAA

SEQ ID NO: 7888 - protein, 244 aa, Triticum aestivum
  misc_feature (1)..(244): Public GI ID NO.58423008
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.246416
  misc_feature (1)..(244): useful for making plants with altered flowering time as described in USSN 12/281,616
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAQAAQQDQTQPQTSSSSSSFMMRDAPPAATTSIHPAASGERAEDAAVQPQAPPRTGLPLWMVSHING

SEQ ID NO: 7889 - protein, 244 aa, Triticum aestivum; identical to SEQ ID NO: 6963
  misc_feature (1)..(244): Public GI ID NO.58423012
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(244): Functional Homolog of  Ceres CLONE NO.246416
  misc_feature (1)..(244): useful for making plants with altered flowering time as described in USSN 12/281,616

SEQ ID NO: 7890 - protein, 241 aa, Lotus japonicus
  misc_feature (1)..(241): Public GI ID NO.60100338
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(241): Functional Homolog of  Ceres CLONE NO.246416
  misc_feature (1)..(241): useful for making plants with altered flowering time as described in USSN 12/281,616
MGRGRVQLKRIENKINRQVTFSKRRAGLLKKAHEISVLCDAEVALIVFSHKGKLFEYATDSCMEKILERYERYAYAERQLVANDSESQGNWTIEYTRLKAKIDLLQRNHRHYMGEDLGSMSLKELQSLEQQLDTALKHIRTRRNQLMYESISELQKKEKVIQEQNNMLAKKIKEKEKIAAQQQHAQWDHPNHGVNAPFLMQQPLPTLNMGGNYREDHAPDVGRNELDLTLEPLYSCHLGCF

SEQ ID NO: 7891 - protein, 239 aa, Eriobotrya japonica
  misc_feature (1)..(239): Public GI ID NO.60116226
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(239): Functional Homolog of  Ceres CLONE NO.246416
  misc_feature (1)..(239): useful for making plants with altered flowering time as described in USSN 12/281,616
MGGGRVQLKRIENKINRQVTFSKRRTGLLKKAHEISVLCDAQVAVVVFSNKGKLFEYATDSCMEQILERYERYSYAERQLVEPEFESQGNWTFEYCRLKAKVEVLQRNHRHYLGEDLDSLTLKEIQNLEQQLDTALKQIRLRKNQLMHESISELQRKRKAIQEENNLLAKKIKEKEKAAAQPQVQDWEQQNIGLDLLPQPLPCLNNGGTQQDEFLQVRRNQLDLTLEPLYSCHLGCFAA

SEQ ID NO: 7892 - protein, 236 aa, Pisum sativum
  misc_feature (1)..(236): Public GI ID NO.62132631
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(236): Functional Homolog of  Ceres CLONE NO.246416
  misc_feature (1)..(236): useful for making plants with altered flowering time as described in USSN 12/281,616
MGRGRVQLKRIENKINRQVTFSKRRCGLLKKAHEISVLCDAEVALIVFSNKGKLYEYSSDPCMERILERYERYSYAERQHVPNDQPQNENWIIEHAKLKARLEVIQKNQRNFMGEELDGLSMKELQNLEHQLDSALKQIRSRKNQVVYESISELQKKDKALQEKNNLLTKKIKEKEKALANFELHNDDMDLDSALVPQPLETPNIGCSPQDRGDNEGSQTQSNALLPPWMLRPIND

SEQ ID NO: 7893 - protein, 250 aa, Salix discolor
  misc_feature (1)..(250): Public GI ID NO.67848418
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(250): Functional Homolog of  Ceres CLONE NO.246416
  misc_feature (1)..(250): useful for making plants with altered flowering time as described in USSN 12/281,616
MGRGRVQLKRIENKINRQVTFSKRRTGLLKKAHEISVLCDAEVALIVFSHKGKLFEYSTDDCMEKILERYERYSYEERQLAATDFDSPGNWTLEYNRLKAKVELLQRNHRNYLGEDLDSMSLKELQNLEQQIDTALKHIRARKNHLMSQSISELQRKEKAIQVQNNMLVKQIKEKEKKDKAVAQPALWDDQQNQGPHASSFLLSQPAGLPLPCLNIGGCYQEETDPEVRRNELDHALEPTYSFHLGGYGA

SEQ ID NO: 7894 - protein, 250 aa, Salix discolor
  misc_feature (1)..(250): Public GI ID NO.67848420
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(250): Functional Homolog of  Ceres CLONE NO.246416
  misc_feature (1)..(250): useful for making plants with altered flowering time as described in USSN 12/281,616
MGRGRVQLKRIENKINRQVTFSKRRTGLLKKAHEISVLCDAEVALIVFSHKGKLFEYSTDDCMEKILERYERYSYEERQLATTDFDSQGNWTLEYNRLKAKVELLQRNHRNYLGEDLDSMSLKELQNLEQQIDTALKHIRARKNHLMSQSISELQRKEKAIQVQNNMLVKQIKEKEKKDKAVAQPAPIWDDQQNQGPHASSFLLSQPAGLPLPCLNIGGCYQEEAPEVRRNELDHALEPTYSFHLGGYGA

SEQ ID NO: 7895 - protein, 240 aa, Medicago truncatula
  misc_feature (1)..(240): Public GI ID NO.72256323
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(240): Functional Homolog of  Ceres CLONE NO.246416
  misc_feature (1)..(240): useful for making plants with altered flowering time as described in USSN 12/281,616
MGRGRVQLKRIENKINRQVTFSKRRAGLLKKAHEISVLCDAEVALIVFSHKGKLFEYATDSCMEKILERYERYSYAERQLVANDSESQGNWTIEYTRLKAKIDLLQRNYRHYMGEDLGSMSLKELQSLEQQLDTALKLIATRRNQVMYESISELQKKEKVIQEQNNMLAKKIKEKEKIAAQQQAQWEHPNHHGVNPNYLLQQQLPTLNMGGNYREEAPEMGRNELDLTLEPLYTCHLGCF

SEQ ID NO: 7896 - protein, 248 aa, Misopates orontium
  misc_feature (1)..(248): Public GI ID NO.82734203
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(248): Functional Homolog of  Ceres CLONE NO.246416
  misc_feature (1)..(248): useful for making plants with altered flowering time as described in USSN 12/281,616
MGRGKVQLKRIENKINRQVTFSKRRGGLLKKAHEISVLCDAEVALIVFSNKGKLFEYSTDSCMDRILEKYERYSFAERQLVSNEPQSPANWTLEYSKLKARIELLQRNHRHYMGEDLDSMSLKELQSLEQQLDTALKNIRSRKNQLLYDSISDLQRKEKAIQEQNTMLAKKIKEKEKELAQQPQWEHHRHHTNASIMPPPPQYSMAPQFPCINVGNTYEGEGANEDRRNELDLTLDSLYSCHLGCFAA

SEQ ID NO: 7897 - DNA, 586 bp, Arabidopsis thaliana
  misc_feature (1)..(586): Ceres CLONE ID no.1010174
  misc_feature (1)..(586): LOCUS At4g09960
  misc_feature (1)..(586): useful for making plants with altered flowering time as described in USSN 12/281,616
atcaagttcccatctttgtacacatctcttcattcaaaaactctacatttatatctctatatatgcagattccaagcttgtaataattcttgtcatcatgggtttttttcttgccttgtctctccagaaaacttaattttcacaattatgaattattttccttatttttgttactttcttctgtttgatgctctttccccatgaaagaaagaaagagaaagaaagatcacaagggttttatttggtcaccagattaagaattaggatgggaagaggaaagatagcmaataaagaggatagagaactcaacaaatcgacaagtgacgttttgcaaaagaagaaatggacttctgaagaaagcctatgagctttcggtcctttgcgatgcagaagttgcgctcattgttttctccactcgtggccgtctctatgaatacgccaataacaacataagatcaaccattgagaggtacaagaaagcttgttctgatagcaccaacactagcactgtccaagaaatcaatgccgcgtactatcaacaagaatctgctaagctgagacaacagatccaaacgattcaaaactc

SEQ ID NO: 7898 - protein, 256 aa, Arabidopsis thaliana
  misc_feature (1)..(256): Ceres CLONE ID NO.1010174
  misc_feature (1)..(256): LOCUS At4g09960
  misc_feature (100)..(199): Pfam Name: K-box Pfam Description: K-box region
  misc_feature (35)..(85): Pfam Name: SRF-TF Pfam Description: SRF-type transcription factor
  misc_feature (1)..(256): useful for making plants with altered flowering time as described in USSN 12/281,616
MLFPHERKKEKERSQGFYLVTRLRIRMGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 7899 - DNA, 675 bp, Populus balsamifera subsp. trichocarpa
  misc_feature (1)..(675): Ceres ANNOT ID no.1540248
  misc_feature (1)..(675): useful for making plants with altered flowering time as described in USSN 12/281,616
atgggaagaggaaagattgagatcaagaggatcgagaacactacgaatcgtcaggttactttctgcaagagaagaaatgggctgttgaagaaagcctatgaattatctgtcctttgtgatgctgaagtttccctcatcgtcttctctagccgtggccgtctctatgagtacgccaacaacaatataagatcaactatagataggtacaagaaggtcagttcagatagttcaaatactgcctctatcacagaaatcaatgcccagtattatcaacaagaatcagcaaagatgcgtcaacaaattcagttgctacagaattctaacaggcacttaatgggagaagccgtgagtaatctgtcggtgaaggagctaaagcagctggagaataggctcgaaagaggcatgactagaatcaggtcaaagaagcatgaattgctgctagctgaaattgagtatatgcagaaaagggagattgagctggaaaatgaaagtgcctgtcttcgaaccaagatagcggaagttgagaggcttcaacaagccaacatggtcaccggagaagagctgaatgcaatccaggcattagcagcctctcgcaatttctttgctcctcattttcttgagggtggaactgcatacccgcacacttataacaagaagattctccatcttgggtaa

SEQ ID NO: 7900 - protein, 224 aa, Populus balsamifera subsp. trichocarpa
  misc_feature (1)..(224): Ceres ANNOT ID NO.1540248
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(224): Functional Homolog of  Ceres CLONE NO.1010174 with e-value of 6.30E-81 and BLAST sequence identity of 75.7
  misc_feature (1)..(224): useful for making plants with altered flowering time as described in USSN 12/281,616
MGRGKIEIKRIENTTNRQVTFCKRRNGLLKKAYELSVLCDAEVSLIVFSSRGRLYEYANNNIRSTIDRYKKVSSDSSNTASITEINAQYYQQESAKMRQQIQLLQNSNRHLMGEAVSNLSVKELKQLENRLERGMTRIRSKKHELLLAEIEYMQKREIELENESACLRTKIAEVERLQQANMVTGEELNAIQALAASRNFFAPHFLEGGTAYPHTYNKKILHLG

SEQ ID NO: 7901 - DNA, 1057 bp, Arabidopsis thaliana; identical to SEQ ID NO: 5278
  misc_feature (1)..(1057): Ceres CLONE ID no.32791
  misc_feature (1)..(1057): useful for making plants with altered flowering time as described in USSN 12/281,616

SEQ ID NO: 7902 - protein, 230 aa, Arabidopsis thaliana; identical to SEQ ID NO: 5279
  misc_feature (1)..(230): Ceres CLONE ID NO.32791
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(230): useful for making plants with altered flowering time as described in USSN 12/281,616

SEQ ID NO: 7903 - DNA, 1218 bp, Zea mays; identical to SEQ ID NO: 7518
  misc_feature (1)..(1218): Ceres CLONE ID no.228787
  misc_feature (1)..(1218): useful for making plants with altered flowering time as described in USSN 12/281,616

SEQ ID NO: 7904 - protein, 260 aa, Zea mays; identical to SEQ ID NO: 7519
  misc_feature (1)..(260): Ceres CLONE ID NO.228787
  misc_feature (105)..(204): Pfam Name: K-box Pfam Description: K-box region
  misc_feature (40)..(90): Pfam Name: SRF-TF Pfam Description: SRF-type transcription factor
  misc_feature (1)..(260): Functional Homolog of  Ceres CLONE NO.1010174 with e-value of 2.39E-63 and BLAST sequence identity of 63.8
  misc_feature (1)..(260): useful for making plants with altered flowering time as described in USSN 12/281,616

SEQ ID NO: 7905 - DNA, 1353 bp, Glycine max
  misc_feature (1)..(1353): Ceres CLONE ID no.1044034
  misc_feature (1)..(1353): useful for making plants with altered flowering time as described in USSN 12/281,616
cagttcacaccctagagggagtggatggattttgttgtttttcatataagggcaaagaaagatagaggagctagctagctagcgagcttcaaaactcaaaagcactgacacatacaaacaaaaagatctggctttcataaaattgagataaaagtgcaccgtctccgaatcatgtttataatattatcttcattagatcttgatctcatttttcatctgaaactaaaagaatatatatgtgcctttaccctatttagctatatgcacacacaacttgtcacatatcatattttgttcatcaagtttataattccttatctttgaacttacttacatccaagtaaggtctaagctagctggagttgattagatctagctagctagttttcgatctgcttaatttgttttccatgatctcttatatatagtaattttatttccctttaattaattaagaaagagttgaagaagaatgggaagggggaagatcgaaatcaaaaggattgagaacacaacaaatcggcaagtgaccttctgcaagagaagaaatgggcttctgaagaaagcttatgagctgtcagtgctgtgtgatgcagaagttgccctcatcgtcttctccagccgtggccgtctctatgagtattccaacaacaacataagatcaacaatagagaggtacaaaaaggcatgttctgatcactcaagcgcgagcactaccacagaaatcaatgctcagtattatcaacaagaatctgcaaagctgcgacagcaaatacagatgctgcaaaattctaacaggcacctgatgggtgatgccttaagcacactgactgtgaaggaacttaagcagttggagaatagacttgaaagaggaatcactagaatcagatctaagaaacatgagatgctactggctgaaattgaatacttccagaaaagggagattgaactggaaaatgaaaatctttgcctccgaactaagataactgacgtggagaggattcagcaagtaaacatggtttctgggccagaactgaatgccattcaggcattagcttcccgtaacttcttcaatccaaatatgttggaaggtggaactgtttaccctcactcagataagaagattcttcatcttgggtgatcaataatatatgatcttggctagcctatggcatgtctatccaattagccggtggctaaatgcattattattactactcttttggttgctcattaactagaccatgtgatctatatactacttatggattatggatacttatgtatgatgattgtatgatatcataacaatcagttagaaataataattaaaaaatagagttgtgtttgaag

SEQ ID NO: 7906 - protein, 222 aa, Glycine max; identical to SEQ ID NO: 5283
  misc_feature (1)..(222): Ceres CLONE ID NO.1044034
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(222): Functional Homolog of  Ceres CLONE NO.1010174 with e-value of 8.60E-84 and BLAST sequence identity of 77.9
  misc_feature (1)..(222): useful for making plants with altered flowering time as described in USSN 12/281,616

SEQ ID NO: 7907 - DNA, 1138 bp, Glycine max
  misc_feature (1)..(1138): Ceres CLONE ID no.1044749
  misc_feature (686)..(686): n is a, c, t, g, unknown, or other
  misc_feature (687)..(687): n is a, c, t, g, unknown, or other
  misc_feature (1)..(1138): useful for making plants with altered flowering time as described in USSN 12/281,616
aaaacattcacgtcgagtacttggtttgggaaaaaaagccattcaagcttagctggtcctctctcctgtctctctctctctgtctgtctctctctgtctgtctctctctcaagcacatacacaaacaaagtaagggctataaataggagggatggaagtggaagaaagtctatagcgaagtttcatttctttggattagaaatttttcccaaagctgatcgagaagccagccaggccagaaggagttgaagaatgggaagggggaagatcgaaatcaaaagaatcgagaacacaacaaatcggcaagtgaccttctgcaagagaagaaatgggcttctgaagaaagcttatgagctgtcagtgctgtgtgatgctgaagtttccctcatcgtcttctccagccgtggccgtctctatgagtattccaacaacaacataagatcaaccatagagaggtacaaaaaagcctgttcggatcattcaagtgcgagcactaccacagaaatcaatgctcagtattatcaacaagaatctgctaagctgcgacagcaaatacagatgctgcaaaattctaacaggcacctgatgggtgatgccttgagcmcactgactgtgaaggaacttaagcagttgggagaatagacttgaaagaggaatcactagaatcagatttaagaaacatgagnngctattggctgaaattgaatactttcagaaaagggagattgagctggaaaatgaaaatctttgcctccggactaagataacygacgttgagaggattcagcaagtaaacatggtttctggaccagaactgaatgtcattcaggcattagcttcccgtaacttcttcaatccaaacatgttggacggtggaactgtttaccctcagacagataagaagattcttcatcttgggtgatcaataatatgatcttcgctatagcctataactatctatccaattagccggaggctaaatgcattattattactactcttttgattgctcattaactagaccaaatgatctatatacattacatatgaattatggattatggatacttatgtttaatgattgtatgatatcataacaatatgttagaaataataattaaaaagtagagttgtgttt

SEQ ID NO: 7908 - protein, 222 aa, Glycine max
  misc_feature (1)..(222): Ceres CLONE ID NO.1044749
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(222): Functional Homolog of  Ceres CLONE NO.1010174 with e-value of 3.69E-83 and BLAST sequence identity of 77.0
  misc_feature (1)..(222): useful for making plants with altered flowering time as described in USSN 12/281,616
MGRGKIEIKRIENTTNRQVTFCKRRNGLLKKAYELSVLCDAEVSLIVFSSRGRLYEYSNNNIRSTIERYKKACSDHSSASTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGPELNVIQALASRNFFNPNMLDGGTVYPQTDKKILHLG

SEQ ID NO: 7909 - protein, 252 aa, Brassica napus
  misc_feature (1)..(252): Public GI ID NO.399096
  misc_feature (25)..(75): Pfam Name: SRF-TF Pfam Description: SRF-type transcription factor
  misc_feature (90)..(189): Pfam Name: K-box Pfam Description: K-box region
  misc_feature (1)..(252): Functional Homolog of  Ceres CLONE NO.1010174 with e-value of 4.90E-65 and BLAST sequence identity of 67.4
  misc_feature (1)..(252): useful for making plants with altered flowering time as described in USSN 12/281,616
MAYQMELGGESSPQRKAGRGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLDRSVNRIRSKKNELLFAEIDYMQKREVDLHNDNQLLRAKIAENERNNPSMSLMPGGSNYEQIMPPPQTQPQPFDSRNYFQVAALQPNNHHYSSAGREDQTALQLV

SEQ ID NO: 7910 - protein, 236 aa, Oryza sativa; identical to SEQ ID NO: 7524
  misc_feature (1)..(236): Public GI ID NO.886405
  misc_feature (74)..(174): Pfam Name: K-box Pfam Description: K-box region
  misc_feature (9)..(59): Pfam Name: SRF-TF Pfam Description: SRF-type transcription factor
  misc_feature (1)..(236): Functional Homolog of  Ceres CLONE NO.1010174
  misc_feature (1)..(236): useful for making plants with altered flowering time as described in USSN 12/281,616

SEQ ID NO: 7911 - protein, 254 aa, Triticum aestivum
  misc_feature (1)..(254): Public GI ID NO.24636577
  misc_feature (30)..(80): Pfam Name: SRF-TF Pfam Description: SRF-type transcription factor
  misc_feature (95)..(194): Pfam Name: K-box Pfam Description: K-box region
  misc_feature (1)..(254): Functional Homolog of  Ceres CLONE NO.1010174 with e-value of 5.59E-64 and BLAST sequence identity of 66.6
  misc_feature (1)..(254): useful for making plants with altered flowering time as described in USSN 12/281,616
MVKESASPGSGSGSPGGAAEKMGRGRIEIKRIENTTNRQVTFCKRRNGLLKKAYELSVLCDAEVALIVFSGRGRLYEYSNNSVKATIERYKKATSDTSSAGTVAEINAQHYQQESAKLKQQITTLQNSNRTLIGDTMATMSHRDLKQLEGRLDKGLGKIRARKNELLCAEIEYMQRREMELQNNNFFLREKVAETERGQQQTLNMMGAASTSNEYEQNMIHCDPRTFLQFNFMQQQPQYYSQQEDRKSLNSVGR

SEQ ID NO: 7912 - protein, 242 aa, Panax ginseng; identical to SEQ ID NO: 5292
  misc_feature (1)..(242): Public GI ID NO.861081
  misc_feature (25)..(75): Pfam Name: SRF-TF Pfam Description: SRF-type transcription factor
  misc_feature (90)..(189): Pfam Name: K-box Pfam Description: K-box region
  misc_feature (1)..(242): Functional Homolog of  Ceres CLONE NO.1010174
  misc_feature (1)..(242): useful for making plants with altered flowering time as described in USSN 12/281,616

SEQ ID NO: 7913 - protein, 229 aa, Cucumis sativus; identical to SEQ ID NO: 5285
  misc_feature (1)..(229): Public GI ID NO.2997615
  misc_feature (74)..(177): Pfam Name: K-box Pfam Description: K-box region
  misc_feature (9)..(59): Pfam Name: SRF-TF Pfam Description: SRF-type transcription factor
  misc_feature (1)..(229): Functional Homolog of  Ceres CLONE NO.1010174 with e-value of 2.10E-82 and BLAST sequence identity of 77.6
  misc_feature (1)..(229): useful for making plants with altered flowering time as described in USSN 12/281,616

SEQ ID NO: 7914 - protein, 248 aa, Nicotiana tabacum
  misc_feature (1)..(248): Public GI ID NO.3913007
  misc_feature (1)..(248): Functional Homolog of  Ceres CLONE NO.1010174 with e-value of 3.69E-67 and BLAST sequence identity of 71.1
  misc_feature (1)..(248): useful for making plants with altered flowering time as described in USSN 12/281,616
MDFQSDLTREISPQRKLGRGKIEIKRIENTTNRQVTFCKRRNGLLKKAYELSVLCDAEVALIVFSSRGRLYEYANNSVKATIERYKKACSDSSNTGSISEANAQYYQQEASKLRAQIGNLQNQNRNMLGESLAALSLRDLKNLEQKIEKGISKIRSKKNELLFAEIEYMQKREIDLHNNNQYLRAKIAETERAQQQQQQQQMNLMPGSSSYELVPPPHQFDTRNYLQVNGLQTNNHYTRQDQPSLQLV

SEQ ID NO: 7915 - protein, 225 aa, Cucumis sativus; identical to SEQ ID NO: 5284
  misc_feature (1)..(225): Public GI ID NO.4103342
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(225): Functional Homolog of  Ceres CLONE NO.1010174 with e-value of 5.29E-84 and BLAST sequence identity of 77.6
  misc_feature (1)..(225): useful for making plants with altered flowering time as described in USSN 12/281,616

SEQ ID NO: 7916 - protein, 242 aa, Corylus avellana
  misc_feature (1)..(242): Public GI ID NO.4103757
  misc_feature (24)..(74): Pfam Name: SRF-TF Pfam Description: SRF-type transcription factor
  misc_feature (90)..(189): Pfam Name: K-box Pfam Description: K-box region
  misc_feature (1)..(242): Functional Homolog of  Ceres CLONE NO.1010174 with e-value of 5.49E-66 and BLAST sequence identity of 66.0
  misc_feature (1)..(242): useful for making plants with altered flowering time as described in USSN 12/281,616
MEFQNQSMSVSPQRKLGRGKIEIKRIENTTNRQVTFCKRRNGLLKKAYELSVLCDAEIALIVFSSRGRLYEYANNSSVKTTIERYKKACADSSNSGSVSEANTQFYQQEAAKLRGQIRSVQDSNRHMLGEALSELNFKELKNLEKNLEKGINRIRSKKNELLLAEIEYMHKREVDLHNNNQFLRAKIAENERNQQNLNVMPGGGNYELMQSQSFDSRNYFQVDALQPNHHYPRQDQMALQLV

SEQ ID NO: 7917 - protein, 264 aa, Gerbera hybrid cv. 'Terra Regina'
  misc_feature (1)..(264): Public GI ID NO.4218160
  misc_feature (103)..(209): Pfam Name: K-box Pfam Description: K-box region
  misc_feature (41)..(91): Pfam Name: SRF-TF Pfam Description: SRF-type transcription factor
  misc_feature (1)..(264): Functional Homolog of  Ceres CLONE NO.1010174 with e-value of 2.40E-65 and BLAST sequence identity of 66.8
  misc_feature (1)..(264): useful for making plants with altered flowering time as described in USSN 12/281,616
MENSDVLELDFSCVDRSMSFPDDTGDMSPQRKMGKGKIEIKRIENTTNRQVTFCKRRNGLLKKAYELSVLCDAEVALIVFSSRGRLYEYANNSVKGTIDKYKKACLDPPTSGTVAEANTQYYQQEAAKLRQQIANLQNQNRQFYRNIMGESLGDMPVKDLKNLEGKLEKAISRIRAKKNELLFAEIEYMQKRELELHNSNQFLRAKIVENERAQQHHMSLMPGSSDYELVTPHQPFDGRNYLQTNDLQPNNDYSCQDQTPLQLV

SEQ ID NO: 7918 - protein, 242 aa, Betula pendula
  misc_feature (1)..(242): Public GI ID NO.8745072
  misc_feature (24)..(74): Pfam Name: SRF-TF Pfam Description: SRF-type transcription factor
  misc_feature (89)..(189): Pfam Name: K-box Pfam Description: K-box region
  misc_feature (1)..(242): Functional Homolog of  Ceres CLONE NO.1010174 with e-value of 9.99E-65 and BLAST sequence identity of 66.0
  misc_feature (1)..(242): useful for making plants with altered flowering time as described in USSN 12/281,616
MEFQNQSMSVSPQRKLGRGKIEIKRIENTTNRQVTFCKRRNGLLKKAYELSVLCDAEIALIVFSSRGRLYEYANNSSVKTTIERYKKACAESSNSGSVSEANTQFYQQEAAKLRGQIRSVQNSNRHLLGEALSELNFKELKNLEIKLEKGINKIRSKKNELLFAEIEYMQKREAELHNNNQILRAKIAENERNQQNLNVMPGGGNYELMQSQSYDSRTYFQVDALQPNHHYPRQDQIPLQLV

SEQ ID NO: 7919 - protein, 223 aa, Vitis vinifera; identical to SEQ ID NO: 5286
  misc_feature (1)..(223): Public GI ID NO.20385590
  misc_feature (69)..(173): Pfam Name: K-box Pfam Description: K-box region
  misc_feature (9)..(59): Pfam Name: SRF-TF Pfam Description: SRF-type transcription factor
  misc_feature (1)..(223): Functional Homolog of  Ceres CLONE NO.1010174 with e-value of 9.90E-83 and BLAST sequence identity of 77.5
  misc_feature (1)..(223): useful for making plants with altered flowering time as described in USSN 12/281,616

SEQ ID NO: 7920 - protein, 234 aa, Hyacinthus orientalis
  misc_feature (1)..(234): Public GI ID NO.21955182
  misc_feature (74)..(174): Pfam Name: K-box Pfam Description: K-box region
  misc_feature (9)..(59): Pfam Name: SRF-TF Pfam Description: SRF-type transcription factor
  misc_feature (1)..(234): Functional Homolog of  Ceres CLONE NO.1010174 with e-value of 2.50E-70 and BLAST sequence identity of 67.5
  misc_feature (1)..(234): useful for making plants with altered flowering time as described in USSN 12/281,616
MGRGKIEIKRIENTTNRQVTFCKRRNGLLKKAYELSVLCDAEVALIVFSTRGRLYEYSNNSIKSTIERDKKACADSSSSSAVIEVNTQRYYQQEASKLRQQIQILQNANRHLMGESLDPLNVKELKQLETRLERGITRVRSKKHELLFAELEYMQKREVELQTDNMYLRAKIGENERAHQASVVQAGTEFDALPTFDSRNYYQVHMLQAASHYSHHQDQTALHLGYETKADPSA

SEQ ID NO: 7921 - protein, 223 aa, Gossypium hirsutum; identical to SEQ ID NO: 5280
  misc_feature (1)..(223): Public GI ID NO.23194453
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(223): Functional Homolog of  Ceres CLONE NO.1010174 with e-value of 3.20E-86 and BLAST sequence identity of 80.1
  misc_feature (1)..(223): useful for making plants with altered flowering time as described in USSN 12/281,616

SEQ ID NO: 7922 - protein, 247 aa, Helianthus annuus
  misc_feature (1)..(247): Public GI ID NO.27657747
  misc_feature (24)..(74): Pfam Name: SRF-TF Pfam Description: SRF-type transcription factor
  misc_feature (86)..(192): Pfam Name: K-box Pfam Description: K-box region
  misc_feature (1)..(247): Functional Homolog of  Ceres CLONE NO.1010174 with e-value of 3.09E-63 and BLAST sequence identity of 68.7
  misc_feature (1)..(247): useful for making plants with altered flowering time as described in USSN 12/281,616
MSFPNESGEMSPQRKLGRGKIEIKRIENTTNRQVTFCKRRNGLLKKAYELSVLCDAEVALIVFSSRGRLYEYANNSVKGTIDRYKKACLDPPSSGSVAEANAQFYQQEAAKLRQQIANLQNQNRQFYRNIMGESLGNMPAKDLKNLEGKLEKGISRIRSKKNELLFAEIEYMPKRENELHNNNQFLRAKIAENERSQQQHMSLMPGSSDYDLVPPHQPFDGRNYLQVNDLQPNNSYSCQDQTPLQLV

SEQ ID NO: 7923 - protein, 227 aa, Momordica charantia; identical to SEQ ID NO: 5287
  misc_feature (1)..(227): Public GI ID NO.27763670
  misc_feature (74)..(177): Pfam Name: K-box Pfam Description: K-box region
  misc_feature (9)..(59): Pfam Name: SRF-TF Pfam Description: SRF-type transcription factor
  misc_feature (1)..(227): Functional Homolog of  Ceres CLONE NO.1010174 with e-value of 3.39E-82 and BLAST sequence identity of 76.6
  misc_feature (1)..(227): useful for making plants with altered flowering time as described in USSN 12/281,616

SEQ ID NO: 7924 - protein, 235 aa, Agapanthus praecox
  misc_feature (1)..(235): Public GI ID NO.29467048
  misc_feature (74)..(174): Pfam Name: K-box Pfam Description: K-box region
  misc_feature (9)..(59): Pfam Name: SRF-TF Pfam Description: SRF-type transcription factor
  misc_feature (1)..(235): Functional Homolog of  Ceres CLONE NO.1010174 with e-value of 4.79E-74 and BLAST sequence identity of 69.6
  misc_feature (1)..(235): useful for making plants with altered flowering time as described in USSN 12/281,616
MGRGKIEIKRIENTTNRQVTFCKRRNGLLKKAYELSVLCDAEVALIVFSTRGRLYEYSNNSIKSTIERYKKACADSSNSTAVVEVNTQQYYQQEAAKLRHQIQSLQNSNRHLMGDSLSSLSIKELKQLENRLERGITRIRSKKHELLFAEIEYMQKREAELQNDNMYLRAKITDNERAHQVSVVQSGTEYDTLPTFDSRNYYTHVTMLEAAPHFSHHQDHTALHLGYETKADPTE

SEQ ID NO: 7925 - protein, 225 aa, Meliosma dilleniifolia
  misc_feature (1)..(225): Public GI ID NO.42794560
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(225): Functional Homolog of  Ceres CLONE NO.1010174 with e-value of 4.49E-71 and BLAST sequence identity of 69.9
  misc_feature (1)..(225): useful for making plants with altered flowering time as described in USSN 12/281,616
MGRGKIEIKRIENTTNRQVTFCKRRNGLLKKAYELSVLCDAEVALIVFSTRGRLYEYANNSVKATIDRYKKACADTSNTGSVSEANAQFYQQESSKLRQQIVILQNSNRHLMGEALSAMTVKELKQLEGRLEKGISRIRSKKNEMLFAEIEYMQKREIDMQNDNMYLRAKIAENERAQQHMSMMPTSEYEAMPPQQFDSRNFLQVNLLEPNHHYSRQEQTALQLG

SEQ ID NO: 7926 - protein, 226 aa, Saruma henryi; identical to SEQ ID NO: 5289
  misc_feature (1)..(226): Public GI ID NO.42794566
  misc_feature (73)..(172): Pfam Name: K-box Pfam Description: K-box region
  misc_feature (9)..(59): Pfam Name: SRF-TF Pfam Description: SRF-type transcription factor
  misc_feature (1)..(226): Functional Homolog of  Ceres CLONE NO.1010174 with e-value of 6.80E-68 and BLAST sequence identity of 68.9
  misc_feature (1)..(226): useful for making plants with altered flowering time as described in USSN 12/281,616

SEQ ID NO: 7927 - protein, 226 aa, Crocus sativus
  misc_feature (1)..(226): Public GI ID NO.45549323
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(226): Functional Homolog of  Ceres CLONE NO.1010174 with e-value of 9.60E-69 and BLAST sequence identity of 66.1
  misc_feature (1)..(226): useful for making plants with altered flowering time as described in USSN 12/281,616
MGRGKIEIKRIENTTNRQVTFCKRRNGLLKKAYELSVLCDAEVALIVFSTRGRLYEYANNSVKGTIDRYKKACTDTSNSGTVSEANSQYYQQEASKLLQQIAQLQNSNRNLMGESLSTMSPRELRQLEGKLEKGINKIRAKKNELLYAEIEYMQKREMELQNDNMYLRNKISENERAQQHMNMLPSATATEYEAMPPFDSRSFLQANLVDPNHHYSHQQQTALQLG

SEQ ID NO: 7928 - protein, 228 aa, Crocus sativus
  misc_feature (1)..(228): Public GI ID NO.45549325
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(228): Functional Homolog of  Ceres CLONE NO.1010174 with e-value of 9.60E-69 and BLAST sequence identity of 66.1
  misc_feature (1)..(228): useful for making plants with altered flowering time as described in USSN 12/281,616
MGRGKIEIKRIENTTNRQVTFCKRRNGLLKKAYELSVLCDAEVALIVFSTRGRLYEYANNSVKGTIDRYKKACTDTSNSGTVSEANSQYYQQEASKLLQQIAQLQNSNRNLMGESLSTMSPRELRQLEGKLEKGINKIRAKKNELLYAEIEYMQKREMELQNDNMYLRNKISENERAQQHMNMLPSATATEYEAMPPFDSRSFLQANLVDPNHHYSHQQQTALQLGFV

SEQ ID NO: 7929 - protein, 229 aa, Akebia trifoliata
  misc_feature (1)..(229): Public GI ID NO.48727598
  misc_feature (16)..(66): Pfam Name: SRF-TF Pfam Description: SRF-type transcription factor
  misc_feature (80)..(180): Pfam Name: K-box Pfam Description: K-box region
  misc_feature (1)..(229): Functional Homolog of  Ceres CLONE NO.1010174 with e-value of 1.20E-72 and BLAST sequence identity of 68.0
  misc_feature (1)..(229): useful for making plants with altered flowering time as described in USSN 12/281,616
MQKREGDMGRGKIEIKRIENTTNRQVTFCKRRNGLLKKAYELSVLCDAEVALIVFSSRGRLYEFSNSSIKSTIERYKKASADSSNTTSIIEANAHYYQHEATKLRQQIQNLQIANRQLMGDSLSSLTVKELKQLENRLERGLTRIRSKKQEIMFAEIEYMQKREVELQKENMYLRAKIAENENAQQTSMVPAQEFDAIQTFDSRNYFQMNMLEGGAAYSHADQTALHLG

SEQ ID NO: 7930 - protein, 243 aa, Prunus persica
  misc_feature (1)..(243): Public GI ID NO.52219460
  misc_feature (25)..(75): Pfam Name: SRF-TF Pfam Description: SRF-type transcription factor
  misc_feature (89)..(189): Pfam Name: K-box Pfam Description: K-box region
  misc_feature (1)..(243): Functional Homolog of  Ceres CLONE NO.1010174 with e-value of 3.69E-67 and BLAST sequence identity of 67.9
  misc_feature (1)..(243): useful for making plants with altered flowering time as described in USSN 12/281,616
MAYENKSMSLDSPQRKLGRGKIEIKRIENTTNRQVTFCKRRNGLLKKAYELSVLCDAEVALIVFSNRGRLYEYANNSVKETIERYKKACAESTNTGSVSEASTQYYQQEAAKLRAQTGNLQNSSRHMMGESLSSMNMKDLKNLESKLEKGINRIRSKKNELLFAEIEYMQKREIDLHNNNQLLRAKIAENERSQQNINVMAGGGSYEIMQSQPYDSRNYFQVNALQPNHQYNSRQDPMALQLV

SEQ ID NO: 7931 - protein, 234 aa, Asparagus virgatus
  misc_feature (1)..(234): Public GI ID NO.57157565
  misc_feature (74)..(174): Pfam Name: K-box Pfam Description: K-box region
  misc_feature (9)..(59): Pfam Name: SRF-TF Pfam Description: SRF-type transcription factor
  misc_feature (1)..(234): Functional Homolog of  Ceres CLONE NO.1010174 with e-value of 1.50E-72 and BLAST sequence identity of 70.2
  misc_feature (1)..(234): useful for making plants with altered flowering time as described in USSN 12/281,616
MGRGKIEIKRIENTTNRQVTFCKRRNGLLKKAYELSVLCDAEVALIVFSSRGRLYEYANNSIKSTIERYKKACADSSNSNAVIEVNSQQYYQQEAAKLRHQIQILQNANRHLMGDSLSSLTVKELKQLENRLERGITRIRSKKHELLFAEIEYMQKREAELQNDNMYLRAKISENERAHQVSVVQPGPEFDTLPTFDSRNYYNVHMLEAAPHYSHHQDQTALHLGYENKADPAA

SEQ ID NO: 7932 - protein, 224 aa, Elaeis guineensis
  misc_feature (1)..(224): Public GI ID NO.58201609
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(224): Functional Homolog of  Ceres CLONE NO.1010174 with e-value of 5.90E-69 and BLAST sequence identity of 66.1
  misc_feature (1)..(224): useful for making plants with altered flowering time as described in USSN 12/281,616
MGRGKIEIKRIENTTNRQVTFCKRRNGLLKKAYELSVLCDAEVALIVFSSRGRLYEYANNSVKATIERYKRACTDTSNSGSVSEADSQYYQQESTKLRQQIISLQNSNRNLMGESLGSMSPRDLKQLEGRLEKGINKIRTKKNELLFAEIEYMQKREVELQNANMYLRNKIAENERAQQQMNMLPQTTEYEVMAPYDSRNFLQVNLMQSNQHYSHQQQTTLPLG

SEQ ID NO: 7933 - protein, 223 aa, Lotus japonicus; identical to SEQ ID NO: 5281
  misc_feature (1)..(223): Public GI ID NO.60100358
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(223): Functional Homolog of  Ceres CLONE NO.1010174 with e-value of 1.19E-84 and BLAST sequence identity of 79.2
  misc_feature (1)..(223): useful for making plants with altered flowering time as described in USSN 12/281,616

SEQ ID NO: 7934 - protein, 221 aa, Prunus dulcis
  misc_feature (1)..(221): Public GI ID NO.63094569
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(221): Functional Homolog of  Ceres CLONE NO.1010174 with e-value of 2.29E-83 and BLAST sequence identity of 76.9
  misc_feature (1)..(221): useful for making plants with altered flowering time as described in USSN 12/281,616
MGRGKIEIKRIENTTNRQVTFCKRRNGLLKKAYELSILCDAEVALIVFSSRGRLYEYSNNNIRNTIEGYKKACSDSSGSTSITEINAQYYQQESAKLRQQIQMLQNSNRHLMGDALSTLSVKELKQLENRLERGINRIRSKKHEMLLAEIEYLQKKEIELENENVCLRTKISEVERLQQANMVGPELNAIQALASRNFFSQNMMEGGATYPQQDKKILHLG

SEQ ID NO: 7935 - protein, 235 aa, Musa acuminata
  misc_feature (1)..(235): Public GI ID NO.66735452
  misc_feature (74)..(174): Pfam Name: K-box Pfam Description: K-box region
  misc_feature (9)..(59): Pfam Name: SRF-TF Pfam Description: SRF-type transcription factor
  misc_feature (1)..(235): Functional Homolog of  Ceres CLONE NO.1010174 with e-value of 1.50E-72 and BLAST sequence identity of 71.4
  misc_feature (1)..(235): useful for making plants with altered flowering time as described in USSN 12/281,616
MGRGKIEIKRIENTTNRQVTFCKRRNGLLKKAYELSVLCDAEVALIVFSSRGRLYEYANNNIKSTIERYKKACADSSSSDAIVDVNSQHYYQQESAKLRHQIQVLQNANRHLMGDALSSLNVKELKQLENRLERSITRIRSKKHELLFAEIEYMQKREVELQSDNMYPRAKIAENERVQQLSIVEAGAEYDAIPGAFDSRNYYHANILEAAAHYSHHQDQTALQLGYETKADSAA

SEQ ID NO: 7936 - protein, 252 aa, Brassica juncea
  misc_feature (1)..(252): Public GI ID NO.67043458
  misc_feature (25)..(75): Pfam Name: SRF-TF Pfam Description: SRF-type transcription factor
  misc_feature (90)..(189): Pfam Name: K-box Pfam Description: K-box region
  misc_feature (1)..(252): Functional Homolog of  Ceres CLONE NO.1010174 with e-value of 4.39E-64 and BLAST sequence identity of 66.9
  misc_feature (1)..(252): useful for making plants with altered flowering time as described in USSN 12/281,616
MAYQTELGGESSSQRKAGRGKIEIKRIENTTNRQVTFCKRRNGLLKKAYELSVLCYAEVALIVFSSRGRLYEYSNNSVKGTIERYKKAISDNSNTGSVAEINAQYYQQESAKLRQQIISIQNSNRQLMGETIGSMSPKELRNLEGRLDRSVNRIRSKKNELLFAEIDYMQKREVDLHNDNQLLRAKIAENERNNPSMSLMPGGSNYEQIMPPPQTQPQPFDSRNYFQVAALQPNNHHYSSAGREDQTALQLV

SEQ ID NO: 7937 - protein, 230 aa, Beta vulgaris
  misc_feature (1)..(230): Public GI ID NO.68132368
  misc_feature (74)..(177): Pfam Name: K-box Pfam Description: K-box region
  misc_feature (9)..(59): Pfam Name: SRF-TF Pfam Description: SRF-type transcription factor
  misc_feature (1)..(230): Functional Homolog of  Ceres CLONE NO.1010174 with e-value of 1.30E-64 and BLAST sequence identity of 67.3
  misc_feature (199)..(199): Xaa is any aa, unknown, or other
  misc_feature (212)..(212): Xaa is any aa, unknown, or other
  misc_feature (1)..(230): useful for making plants with altered flowering time as described in USSN 12/281,616
MGRGKIEIKRIENTTNRQVTFCKRRNGLLKKAYELSVLCDAEVALIVFSSRGRLYEYANHSVKGTIDRYKKACSNQSGAGSVAEANAQYYQQEAAKLRNQIRTATENNRLLSRHMMGEGLSSLSMKELKNLETKLERGISRIRSKKNELLFAEIEFMQKREIELHNNNQFLRARISENERAQQSMSLMPGGSDYDLVPXQSFDSRNYFQVNXLQPSSQYARQDQTPLQLV

SEQ ID NO: 7938 - protein, 242 aa, Castanea mollissima
  misc_feature (1)..(242): Public GI ID NO.73537275
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(242): Functional Homolog of  Ceres CLONE NO.1010174 with e-value of 1.89E-65 and BLAST sequence identity of 67.9
  misc_feature (1)..(242): useful for making plants with altered flowering time as described in USSN 12/281,616
MVYPNQSMSLSPQRKIGRGKMEMKRIENTTNRQVTFCKRRNGLLKKAYELSVLCDAEVALIVFSTRGRLYEYANNSVKSTIERYKKACADSSNTGSVAEANTQFYQQESAKLRAQIGNLQNSKQANDGESLSNLTVKELKSLEIKLERGISRIRSKKNELLFAEIEYMQKREVELHNNNQLLRAKIAENERNQQNLNVMPAGGGSYELMQTQQYDSRNFFQVNALQPNHQYPREDQMSLQLV

SEQ ID NO: 7939 - DNA, 1202 bp, Arabidopsis thaliana; identical to SEQ ID NO: 6775
  misc_feature (1)..(1202): Ceres CLONE ID no.22339
  misc_feature (1)..(1202): Ceres LOCUS ID At3g58780
  misc_feature (1)..(1202): useful for making plants with altered flowering time as described in USSN 12/281,616

SEQ ID NO: 7940 - protein, 248 aa, Arabidopsis thaliana; identical to SEQ ID NO: 6776
  misc_feature (1)..(248): Ceres CLONE ID NO.22339
  misc_feature (1)..(248): Ceres LOCUS ID At3g58780
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(248): useful for making plants with altered flowering time as described in USSN 12/281,616

SEQ ID NO: 7941 - DNA, 717 bp, Populus balsamifera subsp. trichocarpa
  misc_feature (1)..(717): Ceres ANNOT ID no.1139571
  misc_feature (1)..(717): useful for making plants with altered flowering time as described in USSN 12/281,616
atggcataccaaaatgaaccccaagagagctctcccctgaggaagctggggaggggaaaggtggagatcaagcggatcgagaacaccaccaatcgccaagtcactttctgcaaaaggcggaatggtttgctcaagaaagcctatgaattatctgttctttgcgatgctgaggttgcactcatcgtcttctccagccgtggacgcctttatgagtactctaacaatagtgtcaaatctacaattgaaaggtacaaaaaggcatgtgcagattcttccaacaacgggtcagtttctgaagccaatgctcagttttatcagcaagaagctgccaagctgcgctcgcaaattggtaatttgcagaattcaaacaggaatatgctgggtgaatcacttagtgcattgagtgtgaaggaacttaagagcttggagataaaacttgagaaaggaattggtagaattcgttcgaaaaagaatgagctgttgtttgctgaaattgagtatatgcagaagagggagattgacttgcacaacaataaccagcttctccgagcaaagattgcagagaatgaaagaaagcgacagcacatgaatttgatgccgggaggtgtcaacttcgagatcatgcagtctcaaccatttgactctcggaactattctcaagttaatggattgccgcctgccaatcattaccctcatgaagaccagctcttcagttag

SEQ ID NO: 7942 - protein, 238 aa, Populus balsamifera subsp. trichocarpa; identical to SEQ ID NO: 5288
  misc_feature (1)..(238): Ceres ANNOT ID NO.1139571
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(238): Functional Homolog of  Ceres CLONE NO.22339 with e-value of 1.29E-71 and BLAST sequence identity of 68.75
  misc_feature (1)..(238): useful for making plants with altered flowering time as described in USSN 12/281,616

SEQ ID NO: 7943 - DNA, 726 bp, Populus balsamifera subsp. trichocarpa
  misc_feature (1)..(726): Ceres ANNOT ID no.1139572
  misc_feature (1)..(726): useful for making plants with altered flowering time as described in USSN 12/281,616
atggaatatcaaaatgaatcccttgagagctcccccctgaggaagctgggaaggggaaaggtggagatcaagcggatcgagaacaccaccaatcgccaagtcactttctgcaaaaggcgcagtggtttgctcaagaaagcctacgaattatctgttctttgcgatgctgaggttgcactcatcgtcttctctagccgcggtcgcctttatgagtactctaacgatagtgtcaaatcaacaattgagaggtacaaaaaggcatctgcagattcttcaaacactgggtctgtttctgaagccaatgctcagtactaccagcaagaagctgccaagctgcgttcccaaattggtaatttgcagaattcaaacaggcatatgctgggtgaagcgcttagttcattgagtgtgaaggaacttaagagtttggaaatacgacttgagaaaggaataagcagaattcgttccaaaaagaatgagctgttgtttgcagaaatcgagtatatgcagaagagggaggttgacttgcacaacaataaccagcttctccgagcaaagatttcagagaatgaaagaaagcgacagagcatgaatttgatgccaggaggagcagactttgagatcgtgcagtctcaaccatatgactctcggaactattctcaagtgaatggattacagcctgcaagtcattactcacatcaagatcagatggcccttcagttagtttaa

SEQ ID NO: 7944 - protein, 241 aa, Populus balsamifera subsp. trichocarpa
  misc_feature (1)..(241): Ceres ANNOT ID NO.1139572
  misc_feature (24)..(74): Pfam Name: SRF-TF Pfam Description: SRF-type transcription factor
  misc_feature (88)..(188): Pfam Name: K-box Pfam Description: K-box region
  misc_feature (1)..(241): Functional Homolog of  Ceres CLONE NO.22339 with e-value of 8.80E-75 and BLAST sequence identity of 67.0
  misc_feature (1)..(241): useful for making plants with altered flowering time as described in USSN 12/281,616
MEYQNESLESSPLRKLGRGKVEIKRIENTTNRQVTFCKRRSGLLKKAYELSVLCDAEVALIVFSSRGRLYEYSNDSVKSTIERYKKASADSSNTGSVSEANAQYYQQEAAKLRSQIGNLQNSNRHMLGEALSSLSVKELKSLEIRLEKGISRIRSKKNELLFAEIEYMQKREVDLHNNNQLLRAKISENERKRQSMNLMPGGADFEIVQSQPYDSRNYSQVNGLQPASHYSHQDQMALQLV

SEQ ID NO: 7945 - DNA, 417 bp, Arabidopsis thaliana
  misc_feature (1)..(417): Ceres CLONE ID no.103400
  misc_feature (1)..(417): useful for making plants with altered flowering time as described in USSN 12/281,616
aaaaccaaaacagaaaccaaaaacaaaaaataaagttgaagcagcagttaagtggtactgagataataagaatagtatctttaggccaatgaacaaattaactctctcataattcatcttcccatcctcacttctctttctttctgatcataattaatcttgctaagccagctagggcttatagaaatggagggtggtgcgagtaatgaagtagcagagagcagcaagaagatagggagagggaagatagagataaagaggatagagaacactacgaatcgtcaagtcactttctgcaaacgacgcaatggtttactcaagaaagcttatgagctctctgtcttgtgtgacgcctgaggtttggctcttggtcatcttctccactcgaggccgtctctacgagtacgccaacaacag

SEQ ID NO: 7946 - protein, 248 aa, Arabidopsis thaliana
  misc_feature (1)..(248): Ceres CLONE ID NO.103400
  misc_feature (24)..(74): Pfam Name: SRF-TF Pfam Description: SRF-type transcription factor
  misc_feature (89)..(190): Pfam Name: K-box Pfam Description: K-box region
  misc_feature (1)..(248): Functional Homolog of  Ceres CLONE NO.22339 with e-value of 2.59E-20 and BLAST sequence identity of 92.5
  misc_feature (1)..(248): useful for making plants with altered flowering time as described in USSN 12/281,616
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKRVKEIELQNDNMYLRSKITERTGLQQQESSVIHQGTVYESGVTSSHQSGQYNRNYIAVNLLEPNQNSSNQDQPPLQLV

SEQ ID NO: 7947 - DNA, 1303 bp, Zea mays
  misc_feature (1)..(1303): Ceres CLONE ID no.243227
  misc_feature (1)..(1303): useful for making plants with altered flowering time as described in USSN 12/281,616
cttgcttccgatggatcccatcccactgccatcctttctttcccttgcgcgcattgcctagccggccggccggcctgctatattaaaccactttaccccccctctcgctcacgctcgacgcagctcccttttccttgcttgcttattgcaagtctctgcaagaacctgctagagaggaacaagctggtatcgtcgccagcatgggtagaggaaggattgagatcaagaggatsgagaacaacacgagccggcaggtcaccttctgcaagcgccgcaatgggctcctcaagaaggcgtacgagctctccgtcctctgcgacgctgaggtggccctcatcgtcttctctagccgtggtcgcctctacgagtatgccaacaacagtgtcaaggctactgttgagaggtacaagaaggcacacaccgttggctcttcctctgggcccccgctcctagagcacawtgcccagcaattctaccagcaagaatcagcaaaactgcgcaaccagatccagatgctgcaaaacactaacaggcacttggttggtgactccgtgggaaacctgtcactcaaggagctgaagcagctggagagccgccttgagaaaggcatctctaagatcagggccaggaagagtgagctgctggctgcggagatcagttacatggccaaaagggagactgagcttcagaatgaccacatgaccctcaggaccaagattgaggagggagagcaacagctgcagcaggtgaccgtggcacggtcagttgcagcagcagcagctgccaccaacttggagcygaacccattcttggagatggataccaaatgcttcttcactggcggccccttcgcgacgctggacatgaagtgctttctccccggcagcttgcagcagatgctggaggcacagcagcgccagatgctcgccaccgagctgaacctcggctaccaactggcgccgcctggttctgacgctgccaacaataaccctcatcatcagttctaaactggatgcatgtacgagaagcttttcaagcgaactgtgaacggtggaagctggctgttgcctctagatgttcttggcttccatgacctagcttattgcggtgtgtattgttgttgccttttgtgtgtgattctccttgtgctactctacctgatggagaactaaacctaatcgattggacataatgatcaaatgctacagatcctgtgaggctgtgatcaggttaaggcaaaacaagtatactgattgcttaaatgggtttacgmgtgacgacaatgctatttgttgcttctatc

SEQ ID NO: 7948 - protein, 268 aa, Zea mays
  misc_feature (1)..(268): Ceres CLONE ID NO.243227
  misc_feature (75)..(175): Pfam Name: K-box Pfam Description: K-box region
  misc_feature (9)..(59): Pfam Name: SRF-TF Pfam Description: SRF-type transcription factor
  misc_feature (1)..(268): Functional Homolog of  Ceres CLONE NO.22339 with e-value of 9.80E-60 and BLAST sequence identity of 68.9
  misc_feature (1)..(268): useful for making plants with altered flowering time as described in USSN 12/281,616
MGRGRIEIKRIENNTSRQVTFCKRRNGLLKKAYELSVLCDAEVALIVFSSRGRLYEYANNSVKATVERYKKAHTVGSSSGPPLLEHNAQQFYQQESAKLRNQIQMLQNTNRHLVGDSVGNLSLKELKQLESRLEKGISKIRARKSELLAAEISYMAKRETELQNDHMTLRTKIEEGEQQLQQVTVARSVAAAAAATNLELNPFLEMDTKCFFTGGPFATLDMKCFLPGSLQQMLEAQQRQMLATELNLGYQLAPPGSDAANNNPHHQF

SEQ ID NO: 7949 - DNA, 1321 bp, Zea mays
  misc_feature (1)..(1321): Ceres CLONE ID no.246176
  misc_feature (1)..(1321): useful for making plants with altered flowering time as described in USSN 12/281,616
atcagtagtagtggccttttgcccttgcccctcatctctctcaccacctctcttttctcagccttgcttccgatggatcccatcccactgccatcctttctttcccttgcgcgcattgcctagccggccggccggcctgctatattaaaccactttaccccccctctcgctcacgctcgacgcagctcccttttccttgcttgcttattgcaagtctctgcaagaacctgctagagaggaacaagctggtatcgtcgccagcatgggtagaggaaggattgagatcaagaggatcgagaacaacacgagccggcaggtcaccttctgcaagcgccgcaatgggctcctcaagaaggcgtacgagctctccgtcctctgcgacgctgaggtggccctcatcgtcttctctagccgtggtcgcctctacgagtatgccaacaacagtgtcaaggctactgttgagaggtacaagaaggcacacaccgttggctcttcctctgggcccccgctcctagagcacaatgcccagcaattctaccagcaagaatcagcaaaactgcgcaaccagatccagatgctgcaaaacactaacaggcacttggttggtgactccgtgggaaacctgtcactcaaggagctgaagcagctggagagccgccttgagaaaggcatctctaagatcagggccaggaagagtgagctgctggctgcggagatcagttacatggccaaaagggagactgagcttcagaatgaccacatgaccctcaggaccaagattgaggagggagagcaacagctgcagcaggtgaccgtggcacggtcagttgcagcagcagcagctgccaccaacttggagctgaacccattcttggagatggataccaaatgcttcttcactggcggccccttcgcgacgctggacatgaagtgctttctccccggcagcttgcagcagatgctggaggcacagcagcgccagatgctcgccaccgagctgaacctcggctaccaactggcgccgcctggttctgacgctgccaacaataaccctcatcatcagttctaaactggatgcatgtacgagaagcttttcaagcgaactgtgaacggtggaagctggctgttgcctctagatgttcttggcttccatgacctagcttattgcggtgtgtattgttgttgccttttgtgtgtgattctccttgtgctactctacctgatggagaactaaacctaatcgattggacataatgatcaaatgctacagatcctgtgaggctgtgatcaggttaaggcaaaacaagtatactgattgcct

SEQ ID NO: 7950 - protein, 268 aa, Zea mays; identical to SEQ ID NO: 7948
  misc_feature (1)..(268): Ceres CLONE ID NO.246176
  misc_feature (75)..(175): Pfam Name: K-box Pfam Description: K-box region
  misc_feature (9)..(59): Pfam Name: SRF-TF Pfam Description: SRF-type transcription factor
  misc_feature (1)..(268): Functional Homolog of  Ceres CLONE NO.22339 with e-value of 9.80E-60 and BLAST sequence identity of 68.9
  misc_feature (1)..(268): useful for making plants with altered flowering time as described in USSN 12/281,616

SEQ ID NO: 7951 - DNA, 1104 bp, Glycine max
  misc_feature (1)..(1104): Ceres CLONE ID no.1043518
  misc_feature (1)..(1104): useful for making plants with altered flowering time as described in USSN 12/281,616
atattttgcatcctttgtacctgagttcaaggttaacaccaaataacacatatagtgcagattcataagctttcaaccatggaggatccaaatcaagctcaagaagggtcttctcagaagaaaatgggaagagggaagattgaaatcaaacggatcgagaacaccaccaataggcaagtcaccttctgcaagcgccgcaacggtttgctgaagaaagcttatgaattatcagttctgtgtgatgcggaagttgcccttgttgtcttctcaacccgtggccgtttgtatgagtatgccaacaacagtgttagggccaccattgaaaggtacaagaaggcaaatgctgctgcttcaaacgcagaatccgtatctgaagctaacacacagttttaccagcaagagtcatccaaattgagaagacaaattcgagatattcagaatctaaacaggcacatccttggtgaagcacttggttctctgagtctcaaggaactaaagaacctcgagggtagattggagaaaggattaagcagagttagatctagaaagcatgaaacattgtttgctgatgtcgagttcatgcaaaagcgggaaattgagctgcaaaaccacaataattatctgcgagctaagatagctgaacatgagagagctcaacaacagcaatcaaatatgatgtcaggaacactgtgcgagtcccttccttcacaatcatacgacaggaattttttccctgtaaatctcatagcttctgatgatcaacaacaatattctagtcaagaccacactgctctccaacttgtctgatgatatgctggaaattagagctactggaagttctgccacagtcattatatatatatatatatcggttgatgtagctctagctatttgaatagttacgtgtagcacctatatagtgcagagcaaataatgccacacatgcatgcctgcgtttcctgaatcagtttgtgcctttagaattgacgttaatttgctaaaggtcattattagactgcgaacttataaatgatccattttggactcatatttcatacgatatatataatgttaatgtatcttttaataaaaaaaaaaaaaaaa

SEQ ID NO: 7952 - protein, 242 aa, Glycine max; identical to SEQ ID NO: 6785
  misc_feature (1)..(242): Ceres CLONE ID NO.1043518
  misc_feature (24)..(74): Pfam Name: SRF-TF Pfam Description: SRF-type transcription factor
  misc_feature (88)..(188): Pfam Name: K-box Pfam Description: K-box region
  misc_feature (1)..(242): Functional Homolog of  Ceres CLONE NO.22339 with e-value of 4.79E-83 and BLAST sequence identity of 72.9
  misc_feature (1)..(242): useful for making plants with altered flowering time as described in USSN 12/281,616

SEQ ID NO: 7953 - protein, 265 aa, Zea mays
  misc_feature (1)..(265): Public GI ID NO.1001935
  misc_feature (75)..(175): Pfam Name: K-box Pfam Description: K-box region
  misc_feature (9)..(59): Pfam Name: SRF-TF Pfam Description: SRF-type transcription factor
  misc_feature (1)..(265): Functional Homolog of  Ceres CLONE NO.22339 with e-value of 1.19E-59 and BLAST sequence identity of 70.1
  misc_feature (1)..(265): useful for making plants with altered flowering time as described in USSN 12/281,616
MGRGRIEIKRIENNTSRQVTFCKRRNGLLKKAYELSVLCDAEVALVVFSSRGRLYEYANNSVKATIERYKKAHAVGSSSGPPLLEHNAQQFYQQESVKLRNQIQMLQNTNRHLVGDSVGNLSLKELKQLESRLEKGISKIRARKSELLAAEINYMAKRETELQNDHMNLRTKIEEGEQQLQQVTVAQSVAAAAATDVELNPFLEMDTKCFFPGGPFATLDMKCFFPGSLQMLEAQQRQMLATELNLGYQLAPPDTDVANNNPQQF

SEQ ID NO: 7954 - protein, 234 aa, Hordeum vulgare subsp. vulgare
  misc_feature (1)..(234): Public GI ID NO.19698536
  misc_feature (74)..(174): Pfam Name: K-box Pfam Description: K-box region
  misc_feature (9)..(59): Pfam Name: SRF-TF Pfam Description: SRF-type transcription factor
  misc_feature (1)..(234): Functional Homolog of  Ceres CLONE NO.22339 with e-value of 2.29E-67 and BLAST sequence identity of 62.8
  misc_feature (1)..(234): useful for making plants with altered flowering time as described in USSN 12/281,616
MGRGRIEIKRIENTTNRQVTFCKRRNGLLKKAYELSVLCDAEVALVVFSSRGRLYEYSNNSVKATIERYKKANSDTSNSGTVAEVNAQYYQQESSKLRQQISSLQNSNSRSLVRDSVSTMTLRDLKQLEGRLEKGIAKIRARKNELMYAEVEYMQKREMELHNDNIYLRSKVSENERGQQPMNMMASGSTSSEYDHMVAPYDSRNFLQVNMQQQQHYSQQLQPTALQLGQQYFN

SEQ ID NO: 7955 - protein, 265 aa, Oryza sativa
  misc_feature (1)..(265): Public GI ID NO.50902252
  misc_feature (74)..(175): Pfam Name: K-box Pfam Description: K-box region
  misc_feature (9)..(59): Pfam Name: SRF-TF Pfam Description: SRF-type transcription factor
  misc_feature (1)..(265): Functional Homolog of  Ceres CLONE NO.22339
  misc_feature (1)..(265): useful for making plants with altered flowering time as described in USSN 12/281,616
MGRGKIEIKRIENKTSRQVTFCKRRNGLLKKAYELAILCDAEIALIVFSSRGRLYEFSNVNSTRSTIERYKKASASTSGSAPVIDVNSHQYFQQEAAKMRHQIQTLQNANRHLIGESIGNMTAKELKSLENRLEKGISRIRSKKHELLFSEIEYMQKREADLQNENMFLRAKVAEAERAEHDDQQAAEDDEMAPAPAVGGGSSSGTELEALPATFDTREYYQPAPPVSMLAAAAAAAAAQYSSDHHQTALHLGYFKVDSGKGGLL

SEQ ID NO: 7956 - protein, 247 aa, Petunia x hybrida
  misc_feature (1)..(247): Public GI ID NO.396199
  misc_feature (25)..(75): Pfam Name: SRF-TF Pfam Description: SRF-type transcription factor
  misc_feature (90)..(189): Pfam Name: K-box Pfam Description: K-box region
  misc_feature (1)..(247): Functional Homolog of  Ceres CLONE NO.22339 with e-value of 5.80E-78 and BLAST sequence identity of 70.7
  misc_feature (1)..(247): useful for making plants with altered flowering time as described in USSN 12/281,616
MVFPNQEFESSSSQRKSGRGKIEIKRIENTTNRQVTFCKRRNGLLKKAYELSVLCDAEVALIVFSSRGRLYEYANNSVRATIDRYKKHHADSTSTGSVSEANTQYYQQEAAKLRRQIRDIQTYNRQIVGEALSSLSPRGLKNLEGKLEKAIGRVRSKKNELLFSEIELMQKREIEMQNANMYLRAKIAEVERATQQMNLMHGGGSEYQQQPMSSTSQPYDARNFLPVNLLEPNPHYSRQDQTALQLV

SEQ ID NO: 7957 - protein, 247 aa, Petunia integrifolia subsp. inflata
  misc_feature (1)..(247): Public GI ID NO.848999
  misc_feature (25)..(75): Pfam Name: SRF-TF Pfam Description: SRF-type transcription factor
  misc_feature (90)..(189): Pfam Name: K-box Pfam Description: K-box region
  misc_feature (1)..(247): Functional Homolog of  Ceres CLONE NO.22339 with e-value of 2.20E-78 and BLAST sequence identity of 70.7
  misc_feature (1)..(247): useful for making plants with altered flowering time as described in USSN 12/281,616
MVFPNQEFESSSSQRKSGRGKIEIKRIENTTNRQVTFCKRRNGLLKKAYELSVLCDAEVALIVFSSRGRLYEYANNSVRATIDRYKKHHADSTSTGSVSEANTQYYQQEAAKLRRQIRDIQTYNRQIVGEALSSLSPRDLKNLEGKLEKAIGRVRSKKNELLFSEIELMQKREIEMQNANMYLRAKIAEVERATQQMNLMPGGGSEYQQQPMSSTSQPYDARNFLPVNLLEPNPHYSRQDQTALQLV

SEQ ID NO: 7958 - protein, 268 aa, Zea mays; identical to SEQ ID NO: 7948
  misc_feature (1)..(268): Public GI ID NO.1001934
  misc_feature (75)..(175): Pfam Name: K-box Pfam Description: K-box region
  misc_feature (9)..(59): Pfam Name: SRF-TF Pfam Description: SRF-type transcription factor
  misc_feature (1)..(268): Functional Homolog of  Ceres CLONE NO.22339
  misc_feature (1)..(268): useful for making plants with altered flowering time as described in USSN 12/281,616

SEQ ID NO: 7959 - protein, 259 aa, Zea mays; identical to SEQ ID NO: 7521
  misc_feature (1)..(259): Public GI ID NO.2529340
  misc_feature (106)..(206): Pfam Name: K-box Pfam Description: K-box region
  misc_feature (41)..(91): Pfam Name: SRF-TF Pfam Description: SRF-type transcription factor
  misc_feature (1)..(259): Functional Homolog of  Ceres CLONE NO.22339 with e-value of 8.00E-65 and BLAST sequence identity of 64.4
  misc_feature (1)..(259): useful for making plants with altered flowering time as described in USSN 12/281,616

SEQ ID NO: 7960 - protein, 241 aa, Populus balsamifera subsp. trichocarpa; identical to SEQ ID NO: 7944
  misc_feature (1)..(241): Public GI ID NO.2981131
  misc_feature (24)..(74): Pfam Name: SRF-TF Pfam Description: SRF-type transcription factor
  misc_feature (88)..(188): Pfam Name: K-box Pfam Description: K-box region
  misc_feature (1)..(241): Functional Homolog of  Ceres CLONE NO.22339 with e-value of 8.80E-75 and BLAST sequence identity of 67.0
  misc_feature (1)..(241): useful for making plants with altered flowering time as described in USSN 12/281,616

SEQ ID NO: 7961 - protein, 238 aa, Populus balsamifera subsp. trichocarpa; identical to SEQ ID NO: 5288
  misc_feature (1)..(238): Public GI ID NO.2981133
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(238): Functional Homolog of  Ceres CLONE NO.22339 with e-value of 1.29E-71 and BLAST sequence identity of 68.75
  misc_feature (1)..(238): useful for making plants with altered flowering time as described in USSN 12/281,616

SEQ ID NO: 7962 - protein, 248 aa, Lycopersicon esculentum
  misc_feature (1)..(248): Public GI ID NO.3913004
  misc_feature (25)..(75): Pfam Name: SRF-TF Pfam Description: SRF-type transcription factor
  misc_feature (90)..(189): Pfam Name: K-box Pfam Description: K-box region
  misc_feature (1)..(248): Functional Homolog of  Ceres CLONE NO.22339 with e-value of 2.80E-78 and BLAST sequence identity of 66.6
  misc_feature (1)..(248): useful for making plants with altered flowering time as described in USSN 12/281,616
MDFQSDLTREISPQRKLGRGKIEIKRIENTTNRQVTFCKRRNGLLKKAYELSVLCDAEVALVVFSNRGRLYEYANNSVKATIERYKKACSDSSNTGSVSEANAQYYQQEASKLRAQIGNLMNQNRNMMGEALAGMKLKELKNLEQRIEKGISKIRSKKNELLFAEIEYMQKREVDLHNNNQYLRAKIAETERAQHQHQQMNLMPGSSSNYHELVPPPQQFDTRNYLQVNGLQTNNHYPRQDQPPIQLV

SEQ ID NO: 7963 - protein, 246 aa, Gerbera hybrid cv. 'Terra Regina'
  misc_feature (1)..(246): Public GI ID NO.4218162
  misc_feature (24)..(74): Pfam Name: SRF-TF Pfam Description: SRF-type transcription factor
  misc_feature (86)..(192): Pfam Name: K-box Pfam Description: K-box region
  misc_feature (1)..(246): Functional Homolog of  Ceres CLONE NO.22339 with e-value of 3.70E-76 and BLAST sequence identity of 67.7
  misc_feature (1)..(246): useful for making plants with altered flowering time as described in USSN 12/281,616
MSFPNDSGEMSPQRKLGRGKIEIKRIENTTNRQVTFCKRRNGLLKKAYELSVLCDAEVALIVFSSRGRLYEYANNSVKGTIDRYKKACLDPPSSGSVAEANAQFYQQEAAKLRQQIANLQNQNRQFYRNIMGESLGNMPAKDLKNLESKLEKGIGKIRSKKNEILFAEIEYMQKRENELHNSNQFLRSKIAENERAQQHMSLMPGSSDYELVAPHQPFDGRNYLQVNDLQPNNNYSCQDQTPLQLV

SEQ ID NO: 7964 - protein, 246 aa, Antirrhinum majus
  misc_feature (1)..(246): Public GI ID NO.4837612
  misc_feature (25)..(75): Pfam Name: SRF-TF Pfam Description: SRF-type transcription factor
  misc_feature (90)..(190): Pfam Name: K-box Pfam Description: K-box region
  misc_feature (1)..(246): Functional Homolog of  Ceres CLONE NO.22339 with e-value of 1.40E-76 and BLAST sequence identity of 67.9
  misc_feature (1)..(246): useful for making plants with altered flowering time as described in USSN 12/281,616
MASLSDQSTEVSPERKIGRGKIEIKRIENKTNQQVTFCKRRNGLLKKAYELSVLCDAEVALVVFSSRGRLYEYANNSVKATIDRYKKASSDSSLNGSISEANTQYYQQEASKLRAQISNLQNQNRNMLGESLGALSLRELKNLESRVERGISRIRSKKNELLFAEIEYMQKRQEIDLHHNNQYLRAKIAESERVQGQHMNLMPGGSSGYEQLVETQPFDARNYLQVNGLQPNNDYPRQDQLPLQLV

SEQ ID NO: 7965 - protein, 228 aa, Hyacinthus orientalis
  misc_feature (1)..(228): Public GI ID NO.4887235
  misc_feature (75)..(174): Pfam Name: K-box Pfam Description: K-box region
  misc_feature (9)..(59): Pfam Name: SRF-TF Pfam Description: SRF-type transcription factor
  misc_feature (1)..(228): Functional Homolog of  Ceres CLONE NO.22339 with e-value of 8.09E-72 and BLAST sequence identity of 68.1
  misc_feature (1)..(228): useful for making plants with altered flowering time as described in USSN 12/281,616
MGRGKIEIKRIENTTSRQVTFCKRRNGLLKKAYELSVLCDAEVALIVFSTRGRLYEYSNSNSVKTTIERYKKACTDTTNTGTVSEANSQYYQQEATKLRQQITNLQNTNRTLMGESLSTMSLRELKQLEGRLERGINKIRTKKNELLSAEIEYMQKREAEMHNDNMYLRNKIAENERAQQQMNMLPSTATEYEGIPQFDSRNFLQVSLMEPNNHHYSRQQQQTALQLG

SEQ ID NO: 7966 - protein, 244 aa, Liquidambar styraciflua; identical to SEQ ID NO: 6782
  misc_feature (1)..(244): Public GI ID NO.5031217
  misc_feature (28)..(78): Pfam Name: SRF-TF Pfam Description: SRF-type transcription factor
  misc_feature (92)..(191): Pfam Name: K-box Pfam Description: K-box region
  misc_feature (1)..(244): Functional Homolog of  Ceres CLONE NO.22339 with e-value of 3.59E-85 and BLAST sequence identity of 76.0
  misc_feature (1)..(244): useful for making plants with altered flowering time as described in USSN 12/281,616

SEQ ID NO: 7967 - protein, 249 aa, Brassica napus; identical to SEQ ID NO: 6777
  misc_feature (1)..(249): Public GI ID NO.12655901
  misc_feature (1)..(249): Functional Homolog of  Ceres CLONE NO.22339 with e-value of 6.49E-118 and BLAST sequence identity of 92.7
  misc_feature (1)..(249): useful for making plants with altered flowering time as described in USSN 12/281,616

SEQ ID NO: 7968 - protein, 225 aa, Vitis vinifera; identical to SEQ ID NO: 6783
  misc_feature (1)..(225): Public GI ID NO.14279306
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(225): Functional Homolog of  Ceres CLONE NO.22339 with e-value of 4.30E-82 and BLAST sequence identity of 75.5
  misc_feature (1)..(225): useful for making plants with altered flowering time as described in USSN 12/281,616

SEQ ID NO: 7969 - protein, 242 aa, Malus x domestica; identical to SEQ ID NO: 6788
  misc_feature (1)..(242): Public GI ID NO.16973296
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(242): Functional Homolog of  Ceres CLONE NO.22339 with e-value of 3.69E-83 and BLAST sequence identity of 70.6
  misc_feature (1)..(242): useful for making plants with altered flowering time as described in USSN 12/281,616

SEQ ID NO: 7970 - protein, 249 aa, Brassica napus; identical to SEQ ID NO: 6777
  misc_feature (1)..(249): Public GI ID NO.17223670
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(249): Functional Homolog of  Ceres CLONE NO.22339
  misc_feature (1)..(249): useful for making plants with altered flowering time as described in USSN 12/281,616

SEQ ID NO: 7971 - protein, 239 aa, Phalaenopsis equestris
  misc_feature (1)..(239): Public GI ID NO.18650789
  misc_feature (20)..(70): Pfam Name: SRF-TF Pfam Description: SRF-type transcription factor
  misc_feature (85)..(184): Pfam Name: K-box Pfam Description: K-box region
  misc_feature (1)..(239): Functional Homolog of  Ceres CLONE NO.22339 with e-value of 1.40E-74 and BLAST sequence identity of 65.1
  misc_feature (1)..(239): useful for making plants with altered flowering time as described in USSN 12/281,616
MDSSSMEPKEKMGRGKIEIKRIENTTNRQVTFCKRRNGLLKKAYELSVLCDAEVALIIFSTRGRLYEYANNSVKGTIERYKKASTDNSNTGSISEANSQYYQQEATKLRQQITNLQNSNRNLLGDALTTMSLRDLKQLETRLEKGINKIRAKKNELLHAEIDYMQKREMELQTDNMFLRNKISDNERAQQQHQHMSILPSTSTEYEVMPPFDSRSFLHVNLMDPNDRYSHQQQTALQLG

SEQ ID NO: 7972 - protein, 244 aa, Gossypium hirsutum
  misc_feature (1)..(244): Public GI ID NO.19743774
  misc_feature (24)..(74): Pfam Name: SRF-TF Pfam Description: SRF-type transcription factor
  misc_feature (88)..(187): Pfam Name: K-box Pfam Description: K-box region
  misc_feature (1)..(244): Functional Homolog of  Ceres CLONE NO.22339 with e-value of 2.80E-71 and BLAST sequence identity of 71.0
  misc_feature (1)..(244): useful for making plants with altered flowering time as described in USSN 12/281,616
MVYPNESLEDSPQKKMGRGKIEIKRIENTTNRQVTFCKRRNGLLKKAYELSVLCDAEVALVAFSSRGRLYEYANNSVKATIERYKKASDSSNTGSVAEVNAQFYQQEADKLRNQIRNLQNANRHMLGESIGGLPMKELKSLESRLEKGISRIRSKKNELLFAEIEYMQKREIDLHNNNQLLRAKIAENERKQQSMNLMPGGSSANFEALHSQPYDSRNYFQVDALQPATNYYNPQLQQDQIALH

SEQ ID NO: 7973 - protein, 258 aa, Arabidopsis thaliana
  misc_feature (1)..(258): Public GI ID NO.25307910
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(258): Functional Homolog of  Ceres CLONE NO.22339 with e-value of 1.49E-104 and BLAST sequence identity of 86.8
  misc_feature (1)..(258): useful for making plants with altered flowering time as described in USSN 12/281,616
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTVYESGVTSSHQSGQYNRNYIAVNLLEPNQNSSNQDQPPLQLRDLIIYIYLDYVS

SEQ ID NO: 7974 - protein, 248 aa, Arabidopsis thaliana; identical to SEQ ID NO: 7946
  misc_feature (1)..(248): Public GI ID NO.30689162
  misc_feature (24)..(74): Pfam Name: SRF-TF Pfam Description: SRF-type transcription factor
  misc_feature (89)..(190): Pfam Name: K-box Pfam Description: K-box region
  misc_feature (1)..(248): Functional Homolog of  Ceres CLONE NO.22339 with e-value of 8.10E-104 and BLAST sequence identity of 86.8
  misc_feature (1)..(248): useful for making plants with altered flowering time as described in USSN 12/281,616

SEQ ID NO: 7975 - protein, 242 aa, Malus x domestica; identical to SEQ ID NO: 6787
  misc_feature (1)..(242): Public GI ID NO.33308109
  misc_feature (24)..(74): Pfam Name: SRF-TF Pfam Description: SRF-type transcription factor
  misc_feature (88)..(188): Pfam Name: K-box Pfam Description: K-box region
  misc_feature (1)..(242): Functional Homolog of  Ceres CLONE NO.22339 with e-value of 1.30E-82 and BLAST sequence identity of 71.3
  misc_feature (1)..(242): useful for making plants with altered flowering time as described in USSN 12/281,616

SEQ ID NO: 7976 - protein, 244 aa, Ipomoea nil
  misc_feature (1)..(244): Public GI ID NO.37359697
  misc_feature (26)..(76): Pfam Name: SRF-TF Pfam Description: SRF-type transcription factor
  misc_feature (91)..(190): Pfam Name: K-box Pfam Description: K-box region
  misc_feature (1)..(244): Functional Homolog of  Ceres CLONE NO.22339 with e-value of 3.10E-79 and BLAST sequence identity of 70.8
  misc_feature (1)..(244): useful for making plants with altered flowering time as described in USSN 12/281,616
MEFPNQALEEEESSHRKSGRGKIEIKRIENTTNRQVTFCKRRNGLLKKAYELSVLCDAEVALIVFSTRGRLYEYANNSVRATIDRYKKHHSDSTNTGSVSEANTQFYQQESAKLRRQIREIQTSNKQILGESLGVLNHKELKNLEGKVEKAIGRVRSKKNELLFSEIELMQKREIELQNANMYLRAKISEFERAQQQMNLMPGSEYQETMTTSQTYDAHNFLPLTLLEPNQHYSRHDQTALQLV

SEQ ID NO: 7977 - protein, 226 aa, Asparagus virgatus
  misc_feature (1)..(226): Public GI ID NO.46917358
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(226): Functional Homolog of  Ceres CLONE NO.22339 with e-value of 1.19E-77 and BLAST sequence identity of 70.9
  misc_feature (1)..(226): useful for making plants with altered flowering time as described in USSN 12/281,616
MGRGKIEIKRIENTTNRQVTFCKRRNGLLKKAYELSVLCDAEVALIVFSSRGRLYEYANNSVKATIERYKKACTDTTNTGTVSEANSQYYQQEASKLRQQITNLQNSNRNLMGESLSSMGLRDLKQLESRLEKGISKIRSKKNELLYAEIEYMQKREMELQNDNMYLRNKIAENERAQQQMNMLPAATSNEYEGMPQFDSRNFLQVNLLDPNHHYSQQQQTALQLG

SEQ ID NO: 7978 - protein, 245 aa, Akebia trifoliata
  misc_feature (1)..(245): Public GI ID NO.48727610
  misc_feature (29)..(79): Pfam Name: SRF-TF Pfam Description: SRF-type transcription factor
  misc_feature (94)..(193): Pfam Name: K-box Pfam Description: K-box region
  misc_feature (1)..(245): Functional Homolog of  Ceres CLONE NO.22339 with e-value of 1.80E-76 and BLAST sequence identity of 69.0
  misc_feature (1)..(245): useful for making plants with altered flowering time as described in USSN 12/281,616
MCILITDFPNRSSNNSPQRKMGRGKIEIKRIENTTNRQVTFCKRRNGLLKKAYELSVLCDAEVALVVFSNRGRLYEYSNNSVKTTIERYKKACVDSSNSGSVSEANAQFYQQESLKLRQQIGNLQNLNRHLMGEALGSMSIKELKQLETRIEKGISRIRSKKNELLFAEIEYMQKREIDLQNDNMYLRAKIAENERAGQHMNLMPGNEYEVMSSAPFDSRNFLQVNLLEPNNHYSHTDQTALQLG

SEQ ID NO: 7979 - protein, 246 aa, Arabidopsis thaliana; identical to SEQ ID NO: 6780
  misc_feature (1)..(246): Public GI ID NO.52548134
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(246): Functional Homolog of  Ceres CLONE NO.22339 with e-value of 2.10E-105 and BLAST sequence identity of 86.1
  misc_feature (1)..(246): useful for making plants with altered flowering time as described in USSN 12/281,616

SEQ ID NO: 7980 - protein, 246 aa, Arabidopsis thaliana; identical to SEQ ID NO: 6778
  misc_feature (1)..(246): Public GI ID NO.52548150
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(246): Functional Homolog of  Ceres CLONE NO.22339
  misc_feature (1)..(246): useful for making plants with altered flowering time as described in USSN 12/281,616

SEQ ID NO: 7981 - protein, 246 aa, Arabidopsis thaliana; identical to SEQ ID NO: 6779
  misc_feature (1)..(246): Public GI ID NO.52548152
  misc_feature (24)..(74): Pfam Name: SRF-TF Pfam Description: SRF-type transcription factor
  misc_feature (89)..(188): Pfam Name: K-box Pfam Description: K-box region
  misc_feature (1)..(246): Functional Homolog of  Ceres CLONE NO.22339 with e-value of 1.49E-104 and BLAST sequence identity of 86.4
  misc_feature (1)..(246): useful for making plants with altered flowering time as described in USSN 12/281,616

SEQ ID NO: 7982 - protein, 224 aa, Elaeis guineensis
  misc_feature (1)..(224): Public GI ID NO.58201611
  misc_feature (74)..(173): Pfam Name: K-box Pfam Description: K-box region
  misc_feature (9)..(59): Pfam Name: SRF-TF Pfam Description: SRF-type transcription factor
  misc_feature (1)..(224): Functional Homolog of  Ceres CLONE NO.22339 with e-value of 2.59E-75 and BLAST sequence identity of 69.5
  misc_feature (1)..(224): useful for making plants with altered flowering time as described in USSN 12/281,616
MGRGKIEIKRIENTTNRQVTFCKRRNGLLKKAYELSVLCDAEVALIIFSSRGRLYEYANNSVKATIERYKKACTDTSNSGSVSEADSQYYQQESLKLRQQITSLQNSNRNLMGDSLGSMSLRDLKQLEGRLEKGINKIRTKKNELLFAEIEYMQKRETELQNANMYLRNKIAENEGAQQQMNMLPATTEYEVMPPYDSRNFLQVNLMQSNQHYSHQQQTALQLG

SEQ ID NO: 7983 - protein, 241 aa, Pisum sativum; identical to SEQ ID NO: 6784
  misc_feature (1)..(241): Public GI ID NO.62132641
  misc_feature (24)..(74): Pfam Name: SRF-TF Pfam Description: SRF-type transcription factor
  misc_feature (87)..(188): Pfam Name: K-box Pfam Description: K-box region
  misc_feature (1)..(241): Functional Homolog of  Ceres CLONE NO.22339 with e-value of 6.09E-83 and BLAST sequence identity of 75.3
  misc_feature (1)..(241): useful for making plants with altered flowering time as described in USSN 12/281,616

SEQ ID NO: 7984 - protein, 247 aa, Misopates orontium
  misc_feature (1)..(247): Public GI ID NO.82734193
  misc_feature (25)..(75): Pfam Name: SRF-TF Pfam Description: SRF-type transcription factor
  misc_feature (90)..(190): Pfam Name: K-box Pfam Description: K-box region
  misc_feature (1)..(247): Functional Homolog of  Ceres CLONE NO.22339 with e-value of 2.30E-76 and BLAST sequence identity of 67.9
  misc_feature (1)..(247): useful for making plants with altered flowering time as described in USSN 12/281,616
MASLSDQSTEVSPERKIGRGKIEIKRIENTTNRQVTFCKRRNGLLKKAYELSVLCDAEIALVVFSSRGRLYEYANNSVKETIDRYKKASSDSSLNGSISEANTQYYQQEASKLRAQISNLQNQNRNMLGESLGALSLRELKNLESRVERGISRIRSKKNELLFAEIEYMQKRQEIDLHHNNQYLRAKIAESERVQGQHMNLMPGGSSGFEQLVETQPFDARNYLQVNGLQQPNNDYPRQDQLPLQLV

SEQ ID NO: 7985 - protein, 238 aa, Misopates orontium
  misc_feature (1)..(238): Public GI ID NO.82734201
  misc_feature (20)..(70): Pfam Name: SRF-TF Pfam Description: SRF-type transcription factor
  misc_feature (84)..(184): Pfam Name: K-box Pfam Description: K-box region
  misc_feature (1)..(238): Functional Homolog of  Ceres CLONE NO.22339 with e-value of 4.70E-76 and BLAST sequence identity of 69.5
  misc_feature (1)..(238): useful for making plants with altered flowering time as described in USSN 12/281,616
MEFPNQDSERKNGRGKIEIKRIENTTNRQVTFCKRRNGLLKKAYELSVLCDAEVALVVFSSRGRLYEYANNSVRATIDRYKKASADSSNSVSTSEANTQFYQQEANKLRRQIREIQTSNRQMLGEGVGNMALKDLKSTEAKVEKAISRIRSKKNELLFAEIELMQKRELELHNANMFLRAKIAEGERAQQQQMNLMPGSDYQPMTSQSYDVRNFLPMNLMEPNQQQYSRHDQTALQLV

SEQ ID NO: 7986 - DNA, 873 bp, Arabidopsis thaliana
  misc_feature (1)..(873): Ceres CLONE ID no.13660
  misc_feature (1)..(873): Ceres LOCUS ID At5g25210
  misc_feature (1)..(873): useful for making plants with altered flowering time as described in USSN 12/281,616
agtatctcagtacctttacgctttgtttgtctctatcttcttcctgatattcagagaatggtttcatcagatgattggacgaagtgtgcgatgagagatggagaagtggtggcagagcttttggtgaagcttaaagaagccaaagtaatcaagaatccgattgtaacagcgctccggtggggaatccaacagccaaggtctcggtgtccaagaaaagaatctgaatctagatgtagtccaagtacaccactatcttggagtggttgttgtggtggttcttcttcttctccatctggttatgtcgatggttacgaagctactagtcgtcaaatcagtgccgttggatctagatccaagaacatttcatcacttagatcaccattcagcgagcgaggcatcgagaataataacttgaagagaatgaagatgaatcatattcagaatttggcaaaggatgagaattgcaagacagatggcaatttcttgctaccagatttgaatatagtgccatgtgacgaaaatagtgaccactatacgtctttaggtgtggaaacaacactatatgggataaggattataaggtgaaagaagctcacttaatccatgagaaagtggttttgagaatgtttaagctgatctgatcatctttgactcggctttttaaaagggttcgcgccacgcatgagctcgaaaagacaaagagtataaattcctcaaggaagtttcctttgtgtggtggttctatatatgaagatcatcagcaaatgtgtaagatagataaaacaaagagaagaatataatttctggttgtttctttgtagcaataacaaaaacagatattttgtattgattgtctatatttgcacaagtggt

SEQ ID NO: 7987 - protein, 175 aa, Arabidopsis thaliana
  misc_feature (1)..(175): Ceres CLONE ID NO.13660
  misc_feature (1)..(175): Ceres LOCUS ID At5g25210
  misc_feature (1)..(175): useful for making plants with altered flowering time as described in USSN 12/281,616
MVSSDDWTKCAMRDGEVVAELLVKLKEAKVIKNPIVTALRWGIQQPRSRCPRKESESRCSPSTPLSWSGCCGGSSSSPSGYVDGYEATSRQISAVGSRSKNISSLRSPFSERGIENNNLKRMKMNHIQNLAKDENCKTDGNFLLPDLNIVPCDENSDHYTSLGVETTLYGIRIIR

SEQ ID NO: 7988 - DNA, 582 bp, Populus balsamifera subsp. trichocarpa
  misc_feature (1)..(582): Ceres ANNOT ID no.1508840
  misc_feature (1)..(582): useful for making plants with altered flowering time as described in USSN 12/281,616
atggaggagtgggtgacagcggcgatggcagacgagacagtagtagcaaaactactactgcgcctcaaacaatcacaggcgacggcatcagcttccgcggtgccagcggttattcccttgcgatgggggatgcggcttccgaggtcaaggccgggaacgatgacagcaacgaattcttcttcattgagatgcgatgtcgttttgaaaagtaaggaaggcggcggcggcgattcctctactagatgcagtcctaccactcctctttcatggagcggtggtggtgatggtggtgcttctccgtccggtactggtgacggttttgaagaaaccagccgccgccacctcagcagttctcctccgccacctggcgttagatccaagggtgctggtattggtgaaaccactagcaatatagtgaagaggtcaagaaaaaagaagactttttctgaacttaaagaggaggaaacgcagctagtgaaggaaggggtttatcttaaaaaggagatatcaactgtacgtgcaacatttaaggaggagagagctagaaatgagaatttgaagagaattaagggactgagttga

SEQ ID NO: 7989 - protein, 193 aa, Populus balsamifera subsp. trichocarpa
  misc_feature (1)..(193): Ceres ANNOT ID NO.1508840
  misc_feature (1)..(193): Functional Homolog of  Ceres CLONE NO.13660 with e-value of 2.90E-12 and BLAST sequence identity of 39.8
  misc_feature (1)..(193): useful for making plants with altered flowering time as described in USSN 12/281,616
MEEWVTAAMADETVVAKLLLRLKQSQATASASAVPAVIPLRWGMRLPRSRPGTMTATNSSSLRCDVVLKSKEGGGGDSSTRCSPTTPLSWSGGGDGGASPSGTGDGFEETSRRHLSSSPPPPGVRSKGAGIGETTSNIVKRSRKKKTFSELKEEETQLVKEGVYLKKEISTVRATFKEERARNENLKRIKGLS

SEQ ID NO: 7990 - DNA, 549 bp, Glycine max
  misc_feature (1)..(549): Ceres CLONE ID no.474233
  misc_feature (1)..(549): useful for making plants with altered flowering time as described in USSN 12/281,616
atcttttcctccaatacctcctccacccctttctttctctctctctctctctctctctctctcgattatttccctttgatgagtgttgaacggccaagatggtaaacgaagacgagtgggtgcgagcggcgatggcggacgacaccgtcgtggtggagcttctgctacgcctcaagcaaggtaccgtttcacacaaatctcaccaccagcttatacctttctcctggggtgtcaaacagccgcgctcaagatcaaggcttagcgccgccgtctctcgctgcgacgccgccgtttcaaccagatgcagccccaccacgcccctctcttggagcgctggcaccgacagttacgaagactccagccgscaccaccaccaccacgccgscatatctaaggctactgctacaagtggatacactggcaactctgcttctaccaagaggtgcagaagaaaaaagacctttgcagaattaaaggaagaggagagctcccttttmmmggaaagcatatatctgaaaaaggaaatagcaactgtaaatgcaaattttg

SEQ ID NO: 7991 - protein, 150 aa, Glycine max
  misc_feature (1)..(150): Ceres CLONE ID NO.474233
  misc_feature (1)..(150): Functional Homolog of  Ceres CLONE NO.13660
  misc_feature (89)..(89): Xaa is any aa, unknown, or other
  misc_feature (96)..(96): Xaa is any aa, unknown, or other
  misc_feature (133)..(133): Xaa is any aa, unknown, or other
  misc_feature (134)..(134): Xaa is any aa, unknown, or other
  misc_feature (1)..(150): useful for making plants with altered flowering time as described in USSN 12/281,616
MVNEDEWVRAAMADDTVVVELLLRLKQGTVSHKSHHQLIPFSWGVKQPRSRSRLSAAVSRCDAAVSTRCSPTTPLSWSAGTDSYEDSSXHHHHHAXISKATATSGYTGNSASTKRCRRKKTFAELKEEESSLXXESIYLKKEIATVNANF

SEQ ID NO: 7992 - DNA, 1356 bp, Glycine max
  misc_feature (1)..(1356): Ceres CLONE ID no.745881
  misc_feature (1)..(1356): useful for making plants with altered flowering time as described in USSN 12/281,616
ttttttcctccaatacctcctccacccctttctttctctctctctctctctctctctctctcgattatttccctttgatgagtgttgaacggccaagatggtaaacgaagacgagtgggtgcgagcggcgatggcggacgacaccgtcgtggtggagcttctgctacgcctcaagcaaggtaccgtttcacacaaatctcaccaccagcttatacctttctcctggggtgtcaaacagccgcgctcaagatcaaggcttagcgccgccgtctctcgctgcgacgccgccgtttcaaccagatgcagccccaccacgcccctctcttggagcgctggcaccgacagttacgaagactccagccgccaccaccaccaccacgccgccatatctaaggctactgctacaagtggatacactggcaactctgcttctaccaagaggtgcagaagaaaaaagacctttgcagaattaaaggaagaggagagctcccttctaaaggaaagcatatatctgaaaaaggaaatagcaactgtaaatgcaaattttgaggcacagagagctaaaaatgagagtctgaagagaatgaagcttgatgtgggattaaaatatcatcagaacaatccaagttcaacatctgttgaaccgcagtgtgtgcttgctggtcaaccccatcagagaatagtagtatcttcggaggccctcatacgtcccattcaagatgatactcattcacatgcatcagaatctaggccaaacaagatagaatcaaccaccgggaaaagttttttcttgataccagatctaaatatgatgccgtccgaggatgtttcttgcactgacaatctatgtggaatgagttgagacgacctttctctcttactatatgtgttggggatacaaatctgaacaatgtacaggccaagagagcattttgaaggctctgtccaatagaaaacctatggaaaacgtgttgggtgcactattaacgtttcttggtgtgactactaattcttatgaatggaaaagaaattggtagtcatatatatgggaaaattttcttgggtagttctagccattatgctgtagagtagagagatatgctaaggttgcaggttccttcgattccgaaatttcttaaaaacctttccgatttcggaattcttcaatcatgtcaggtgtaccattcttttgtaggttaaaagctcttggattcccttagaaggtatcttaaatctaaatattcatcgatttccatctgttacttcttcatttctttttatctacaagcaagtcgtgtgtcacctcttcgatataatgtatatgatgtttttcttggtttaaaaaaaaaaaaaaaa

SEQ ID NO: 7993 - protein, 254 aa, Glycine max
  misc_feature (1)..(254): Ceres CLONE ID NO.745881
  misc_feature (1)..(254): Functional Homolog of  Ceres CLONE NO.13660 with e-value of 4.69E-17 and BLAST sequence identity of 39.8
  misc_feature (1)..(254): useful for making plants with altered flowering time as described in USSN 12/281,616
MVNEDEWVRAAMADDTVVVELLLRLKQGTVSHKSHHQLIPFSWGVKQPRSRSRLSAAVSRCDAAVSTRCSPTTPLSWSAGTDSYEDSSRHHHHHAAISKATATSGYTGNSASTKRCRRKKTFAELKEEESSLLKESIYLKKEIATVNANFEAQRAKNESLKRMKLDVGLKYHQNNPSSTSVEPQCVLAGQPHQRIVVSSEALIRPIQDDTHSHASESRPNKIESTTGKSFFLIPDLNMMPSEDVSCTDNLCGMS

SEQ ID NO: 7994 - DNA, 639 bp, Parthenium argentatum
  misc_feature (1)..(639): Ceres CLONE ID no.1603950
  misc_feature (1)..(639): useful for making plants with altered flowering time as described in USSN 12/281,616
atcaccctattactatttcacatctcatcttcttctccactctctctctctaacctctttctctctctacacgaacaataacaaacacaaaacaacagatgacgaaagaacggtggatacaatcagcgttaactaacgacgagctggtggcggaccttctgctacgtctaaaacaacactcttcagatttagattcagattcgttattaataaagaaaacggttacaacgacgattattgttccgccttgttgggggaatcggaagactcgatcgaaatcaacggctgttgttaaaggatttggtaaagaacaccgtggtagtcccaccacgcatctgtcgtggagcggtggtggtggttcgagtagtgattgtagtcgtccgtcagatatgtcctctggttgtagatctgttaaggcaaatgaaggaccatcaatatccagctacaacaatttggatcaaaaccatagaaacaagatgagaaagatggaattatgtagcgaaaaagcggaaaccgagggaccgagaagggggtttgtattgcccgatttgaacatgacaccgaatgaggacgatatgtcgatgatggtgatgatatgagaatgaatgaagatcaagaaagatttctttatgtttctga

SEQ ID NO: 7995 - protein, 166 aa, Parthenium argentatum
  misc_feature (1)..(166): Ceres CLONE ID NO.1603950
  misc_feature (1)..(166): Functional Homolog of  Ceres CLONE NO.13660 with e-value of 4.99E-8 and BLAST sequence identity of 34.5
  misc_feature (1)..(166): useful for making plants with altered flowering time as described in USSN 12/281,616
MTKERWIQSALTNDELVADLLLRLKQHSSDLDSDSLLIKKTVTTTIIVPPCWGNRKTRSKSTAVVKGFGKEHRGSPTTHLSWSGGGGSSSDCSRPSDMSSGCRSVKANEGPSISSYNNLDQNHRNKMRKMELCSEKAETEGPRRGFVLPDLNMTPNEDDMSMMVMI

SEQ ID NO: 7996 - DNA, 1427 bp, Glycine max
  misc_feature (1)..(1427): Ceres CLONE ID no.1621236
  misc_feature (1)..(1427): useful for making plants with altered flowering time as described in USSN 12/281,616
aactcgaatctactccatcttccaccttcctccttcctcacccccacacaatatcctcaccccttcgctcattttttctttttattattaaaactaaaattatactagtatataaacctatgctcattccactctttatcttttcctccaatacctccgccaccactctctctctctctctctctctctcttcaatactcacgctagattatttccctttgatgagtgttgaacggccaagatggtgaacgacgacgagtgggtgcgtgcggcgatggaggatgacaccgttgtggtggagcttctgctacgcctcaagcaaggtaccgttttacacaaatctcaccaccagcagcttttacctttctcctggggagtcaaacagccgcgctcaagatcaaggctaacctccgccgccgtctcccgatgcgacgccgccgtttccaccagatgcagccccaccacgcccctctcttggagcgccggcgccgacagttacgaagactccagccgccaccaccaccatcacgccgccgtatccaaggctactgctacaagtggatacactggcaactctgcttctaccaagaggtgcagaagaaaaaagacctttgcagaattaaaggaagaggagagctccctgctaaaggaaagcatatatctgaaaaaggaaatagcgtctgtaaatgcaaactttgaggcacagagagctaaaaatgagagtctgaagagaatgaagcttgatgtgggatcaaaatatcagaacaatccaagttcaacatctgttgaaccgcagcgtctgcctgctggtcaaccccatcagagaatagtggtatctacggaggccctcatacgtcccattcaagaagatactcattcacttgcatcagaatctaggccaaacaggataaaatcaaccggggaaagttttttcttgataccagatctaaatatggtgccgtccgaggatgtttcttgcactgacgctctatgtggaatgagttgagacctctttctcttactatgtgtgttggggatacaaatctgaacaatgtacaggcccagagagctatttgaaggctctatccaatagaaaaccaatgaatatcgtggtgcactagaaacgtttcttgatctgactactaattcttatgaatggaaaagaaattggtagtcatatatatgggaaaattttcttgggtagttctagccattaggctgtagagtagagagatatgctaaaaagttcgcaggttcctccgattccgaaattcttaaaaacctttccgatttcggaattcgtcaatcatgtcagatgtaccaattcttttgtaggttaaacgctcttggattcccttagaaggtatctaaaatctaaaatcaatatacaattttatatttttattcaaaaaaaaaaaaaaaaaaaa

SEQ ID NO: 7997 - protein, 254 aa, Glycine max
  misc_feature (1)..(254): Ceres CLONE ID NO.1621236
  misc_feature (1)..(254): Functional Homolog of  Ceres CLONE NO.13660 with e-value of 9.20E-14 and BLAST sequence identity of 39.8
  misc_feature (1)..(254): useful for making plants with altered flowering time as described in USSN 12/281,616
MVNDDEWVRAAMEDDTVVVELLLRLKQGTVLHKSHHQQLLPFSWGVKQPRSRSRLTSAAVSRCDAAVSTRCSPTTPLSWSAGADSYEDSSRHHHHHAAVSKATATSGYTGNSASTKRCRRKKTFAELKEEESSLLKESIYLKKEIASVNANFEAQRAKNESLKRMKLDVGSKYQNNPSSTSVEPQRLPAGQPHQRIVVSTEALIRPIQEDTHSLASESRPNRIKSTGESFFLIPDLNMVPSEDVSCTDALCGMS

SEQ ID NO: 7998 - protein, 204 aa, Arabidopsis thaliana
  misc_feature (1)..(204): Public GI ID NO.42573123
  misc_feature (1)..(204): Functional Homolog of  Ceres CLONE NO.13660 with e-value of 2.19E-14 and BLAST sequence identity of 52.0
  misc_feature (1)..(204): useful for making plants with altered flowering time as described in USSN 12/281,616
MKKVTSSKIPAKDDWVAVAITDDDLVVELLLRLKHAGTVVSDNPAVILPPLRWGIRQRRSRSSRFGGGGGVLVSLKKDVDSVRASPKTPLSWSGGSGSGGGSASPSADGFEDNSRQASCSTSTGSGSKVFPTNEITSCFSKRLKKRKSSFELKNEENLKLKERLDLEKVDFRCYSLFYYHGFHCILKKTQYFSTGDCKSPSNIR

SEQ ID NO: 7999 - protein, 253 aa, Arabidopsis thaliana
  misc_feature (1)..(253): Public GI ID NO.21593304
  misc_feature (1)..(253): Functional Homolog of  Ceres CLONE NO.13660
  misc_feature (1)..(253): useful for making plants with altered flowering time as described in USSN 12/281,616
MKKVTSSKIPAKDDWVAVAITDDDLVVELLLRLKHAGTVVSDNPAVILPPLRWGIRQRRSRSSRFGGGGGVLVSLKKDVDSVRASPKTPLSWSGGSGSGGGSASPSADGFEDNSRQASCSTSTGSGSKVFPTNEITSCFSKRLKKRKSSFELKNEENLKLKERLDLEKEIASLRATFDEQNLRNQKLKRIKLDLNSGRVTNKKPVDLIRKSQLERLQGSKSCKTSDSQNQGSFFVLPDLNMAPSEEEILYGTS

SEQ ID NO: 8000 - DNA, 1535 bp, Glycine max
  misc_feature (1)..(1535): Ceres CLONE ID no.708396
  misc_feature (1)..(1535): useful for making plants with altered flowering time as described in USSN 12/281,616
attcacttctgatttgattcttttccccactttcagaacatcaacaaagtagagagagagaaccaaaaaaaaaaaactactactcaacaaaaagagctagagagaagataccccttaaatcctaatttctacctcaaagaaagtactcttcaaacattttgtattcactgaagaaggatctttgcacttgcacctgcagccatctaccatggttaagtcagaacacaagatcaaaaccgaaccatcatcaaaggcaatgcggttatcttcaccctcatcatcaacatcagattgcaagaagaagaagtacaagggagtgagaatgaggagctggggatcatgggtttctgagattagagcaccaaatcagaaaacaagaatatggttaggctcttattcaaccccagaagctgcagctagagcctatgatgctgcacttctatgccttaaaggctcctcagcaaatctcaatttccctttaagctcttcacaacaatacattcctggagatgctgtcatgtcccccaaatcaatccaaagagttgctgcggccgccgcaaatagtttcatcgacaatgccaccactcccccttccccacctccggcttcgaccccatcatcatcatcattggcctcatccccctcattggtttcttctccctcggatcaaatcgatgacgacgccttgctgatatcgtctttccaagcctacactagttgtggtcaagcaaatcaatcaatggctgtgaatgtgatggagccttggtacacctttggtgatggtcttcaatcccccaagtatgctgatcagatgctaagtggtgatttcttccatgtcgattcttcccatctgcttgatgatctatacgaagaaagtgacattcgtttgtggagcttctgctgagaaaaaaaatcaattcaagccacctacaatatttcttcttttctcaaaaattcaattcgtttgtcttcagtggtatagcttaagatgttactgactgtgaccaaattaaaatttgtataccctatgctacataaatggtgcattttagatgaaattcatatagagataagacaattttcggcctctcatgtgaatttctaagagtttgaaattatgtatcatcgatacaaatcttggtatgtcaatgtcatgaatggtttcccatgtgtcacagaatataagggagaaaaaaaaatgtagtcaccaaaatccttaggtataagcaattcgtttcactgtttttggaatgtaactatgggaggagacttttgctattgtgagtatctttggaaggcctttgttgcatgggaaggtatcagagatgcttatttccaattcagtgagaatagggaaccatgtacagagcgtggtaacttgaaaccattggaaaaattgcatcttttctaagccttgtctgctctcccgcgtgcccaaagaacaaagagtgttcccttgttttgatgtttaagtttggtattttataccctattctattcttcttttagatggaaataaatcctggttaattttc

SEQ ID NO: 8001 - protein, 231 aa, Glycine max
  misc_feature (1)..(231): Ceres CLONE ID NO.708396
  misc_feature (32)..(95): Pfam Name: AP2 Pfam Description: AP2 domain
  misc_feature (1)..(231): useful for making plants with altered flowering time as described in USSN 12/281,616
MVKSEHKIKTEPSSKAMRLSSPSSSTSDCKKKKYKGVRMRSWGSWVSEIRAPNQKTRIWLGSYSTPEAAARAYDAALLCLKGSSANLNFPLSSSQQYIPGDAVMSPKSIQRVAAAAANSFIDNATTPPSPPPASTPSSSSLASSPSLVSSPSDQIDDDALLISSFQAYTSCGQANQSMAVNVMEPWYTFGDGLQSPKYADQMLSGDFFHVDSSHLLDDLYEESDIRLWSFC

SEQ ID NO: 8002 - DNA, 648 bp, Populus balsamifera subsp. trichocarpa
  misc_feature (1)..(648): Ceres ANNOT ID no.1443312
  misc_feature (1)..(648): useful for making plants with altered flowering time as described in USSN 12/281,616
atggtgaagaacgagcacaagatccagtcagagacttcaacgccaatgccaacatcttcatcagcatgcaagaagaagaaatacaagggagttagaatgagaagttggggctcatgggtttctgagataagggcaccaaatcaaaaaacaagaatatggttaggctcttattcaactcctgaagctgctgctagagcctatgatgctgcacttttatgtcttaagggctcttcagccaatctcaactttcctattacttcctcgcattacattcctgacgctgtgatgtcccccaagtccattcagagagtggctgcagctgctgctaatagctctgaagacaatcccaccacccctcaagtatcctcacttcctcttccttcctcctcctcctcgtcatcatcatcaatcctatcatccccgtcaatggtttcctcaccgtccgatcagccagatgattatatgtcactaatggaatcgtttgagaccgacaatgaaccaattccaatgctagattcttggtacaattttgatggattacaatcaccaaagtatattgatcaaatgttcaatggggtctcattcaatccaccgatgatcgatgatttctacgaaggcgatattcgtctatggagctttgctgaatag

SEQ ID NO: 8003 - protein, 215 aa, Populus balsamifera subsp. trichocarpa
  misc_feature (1)..(215): Ceres ANNOT ID NO.1443312
  misc_feature (1)..(215): Functional Homolog of  Ceres CLONE NO.708396 with e-value of 4.30E-66 and BLAST sequence identity of 73.2
  misc_feature (1)..(215): useful for making plants with altered flowering time as described in USSN 12/281,616
MVKNEHKIQSETSTPMPTSSSACKKKKYKGVRMRSWGSWVSEIRAPNQKTRIWLGSYSTPEAAARAYDAALLCLKGSSANLNFPITSSHYIPDAVMSPKSIQRVAAAAANSSEDNPTTPQVSSLPLPSSSSSSSSSILSSPSMVSSPSDQPDDYMSLMESFETDNEPIPMLDSWYNFDGLQSPKYIDQMFNGVSFNPPMIDDFYEGDIRLWSFAE

SEQ ID NO: 8004 - DNA, 720 bp, Populus balsamifera subsp. trichocarpa
  misc_feature (1)..(720): Ceres ANNOT ID no.1452068
  misc_feature (1)..(720): useful for making plants with altered flowering time as described in USSN 12/281,616
atggctggacagacagagagcatttggtttttgaaggttgcaaaatctatattgctccatctaacaatggtgaagagcgagcacagaatccagtcagaggcttcaaaaccagtggccatatcatcaacgccttcaccgtcagcatgcaagaagaggaaatacaagggagttagaatgagaagttggggctcatgggtgtcagagataagggcaccgaatcagaaaacaagaatatggttaggctcttattcaactcctgaagctgctgctagagcctatgatgctgcacttttttgtctcaagggctccgcagccgctctcaactttcctattacttcctcgcattacattcctgacactgttatgtccccgaagtccattcaaagagtggctgcagctgccgctaatagttttgtagacaatcccaccaccccacagtcatcatcacctcctctcccttgttcctcctcctcctcctcgtcaatctcatcacccccatcagtggtttcctcgccgtccgatattcagcttgatgattatatatcactgatggaatcttttgagaccaacaatgaaccagtttcaatgctagattcttggtacaattttgatgtcttacaatcaccgaagtatcttgatctcaattgggtctcattcaatccaccaatgatcgatgatttatacgaaggggatcttcgtctatggagctttgctgaatag

SEQ ID NO: 8005 - protein, 239 aa, Populus balsamifera subsp. trichocarpa
  misc_feature (1)..(239): Ceres ANNOT ID NO.1452068
  misc_feature (1)..(239): Functional Homolog of  Ceres CLONE NO.708396 with e-value of 2.09E-64 and BLAST sequence identity of 72.0
  misc_feature (1)..(239): useful for making plants with altered flowering time as described in USSN 12/281,616
MAGQTESIWFLKVAKSILLHLTMVKSEHRIQSEASKPVAISSTPSPSACKKRKYKGVRMRSWGSWVSEIRAPNQKTRIWLGSYSTPEAAARAYDAALFCLKGSAAALNFPITSSHYIPDTVMSPKSIQRVAAAAANSFVDNPTTPQSSSPPLPCSSSSSSSISSPPSVVSSPSDIQLDDYISLMESFETNNEPVSMLDSWYNFDVLQSPKYLDLNWVSFNPPMIDDLYEGDLRLWSFAE

SEQ ID NO: 8006 - DNA, 654 bp, Populus balsamifera subsp. trichocarpa
  misc_feature (1)..(654): Ceres ANNOT ID no.1505156
  misc_feature (1)..(654): useful for making plants with altered flowering time as described in USSN 12/281,616
atggtgaagagcgagcacagaatccagtcagaggcttcaaaaccagtggccatatcatcaacgccttcaccgtcagcatgcaagaagaggaaatacaagggagttagaatgagaagttggggctcatgggtgtcagagataagggcaccgaatcagaaaacaagaatatggttaggctcttattcaactcctgaagctgctgctagagcctatgatgctgcacttttttgtctcaagggctccgcagccgctctcaactttcctattacttcctcgcattacattcctgacactgttatgtccccgaagtccattcaaagagtggctgcagctgccgctaatagttttgtagacaatcccaccaccccacagtcatcatcacctcctctcccttgttcctcctcctcctcctcgtcaatctcatcacccccatcagtggtttcctcgccgtccgatattcagcttgatgattatatatcactgatggaatcttttgagaccaacaatgaaccagtttcaatgctagattcttggtacaattttgatgtcttacaatcaccgaagtatcttgatctcaattgggtctcattcaatccaccaatgatcgatgatttatacgaaggggatcttcgtctatggagctttgctgaatag

SEQ ID NO: 8007 - protein, 217 aa, Populus balsamifera subsp. trichocarpa
  misc_feature (1)..(217): Ceres ANNOT ID NO.1505156
  misc_feature (30)..(93): Pfam Name: AP2 Pfam Description: AP2 domain
  misc_feature (1)..(217): Functional Homolog of  Ceres CLONE NO.708396 with e-value of 2.09E-64 and BLAST sequence identity of 72.0
  misc_feature (1)..(217): useful for making plants with altered flowering time as described in USSN 12/281,616
MVKSEHRIQSEASKPVAISSTPSPSACKKRKYKGVRMRSWGSWVSEIRAPNQKTRIWLGSYSTPEAAARAYDAALFCLKGSAAALNFPITSSHYIPDTVMSPKSIQRVAAAAANSFVDNPTTPQSSSPPLPCSSSSSSSISSPPSVVSSPSDIQLDDYISLMESFETNNEPVSMLDSWYNFDVLQSPKYLDLNWVSFNPPMIDDLYEGDLRLWSFAE

SEQ ID NO: 8008 - DNA, 1160 bp, Arabidopsis thaliana
  misc_feature (1)..(1160): Ceres CLONE ID no.19721
  misc_feature (1)..(1160): useful for making plants with altered flowering time as described in USSN 12/281,616
atctctatccatccacaacaacaacaaaaactcaagaacaatatctccacttgatcactaccacattgtccaatcactctacaaagcctgtacgtacacaacaacattaccatggtgaaacaagaacgcaagatccaaaccagcagcacaaaaaaggaaatgcctttgtcatcatcaccatcttcttcttcttcttcttcatcttcttcctcgtcttcgtcttcgtgtaagaacaagaacaagaagagtaagattaagaagtacaaaggagtgaggatgagaagttggggatcatgggtctctgagattagggcaccaaatcaaaagacaaggatttggttaggttcttactcaacagctgaagcagctgctagagcttacgatgttgcactcttatgtctcaaaggccctcaagccaatctcaacttccctacttcttcttcttctcatcatcttcttgataatctcttagatgaaaatacccttttgtcccccaaatccatccaaagagtagctgctcaagctgccaactcatttaaccattttgcccctacttcatcagccgtctcgtcaccgtccgatcatgatcatcaccatgatgatgggatgcaatctttgatgggatcttttgtggacaatcatgtgtctttgatggattcaacatcttcatggtatgatgatcataatgggatgttcttgtttgataatggagctccattcaattactctcctcaactaaactcgacgacgatgctcgatgaatacttctacgaagatgctgacattccgctttggagtttcaattaatccgacggtccataatacatactttaattagttttctaaatcattttttaaattcttttttatatatgtaacatatatttaccctcgtcgtaattattcatttccaagttgtttgttgcttggagagaattgacgacggatacgattatataatataattgtaagtttttatatgtagcaaactcggtacaattcggatttaatagggatctaggaagttcacatgaacaagcgactcttttttttgtcacttctttgactttttcatgtgaggtttcttttcatcaattttttttaacaatgtgtgaaaatatttctgtattgtaatgatatatttcgcacaatagttttgc

SEQ ID NO: 8009 - protein, 231 aa, Arabidopsis thaliana
  misc_feature (1)..(231): Ceres CLONE ID NO.19721
  misc_feature (49)..(112): Pfam Name: AP2 Pfam Description: AP2 domain
  misc_feature (1)..(231): Functional Homolog of  Ceres CLONE NO.708396
  misc_feature (1)..(231): useful for making plants with altered flowering time as described in USSN 12/281,616
MVKQERKIQTSSTKKEMPLSSSPSSSSSSSSSSSSSSSCKNKNKKSKIKKYKGVRMRSWGSWVSEIRAPNQKTRIWLGSYSTAEAAARAYDVALLCLKGPQANLNFPTSSSSHHLLDNLLDENTLLSPKSIQRVAAQAANSFNHFAPTSSAVSSPSDHDHHHDDGMQSLMGSFVDNHVSLMDSTSSWYDDHNGMFLFDNGAPFNYSPQLNSTTMLDEYFYEDADIPLWSFN

SEQ ID NO: 8010 - DNA, 1299 bp, Zea mays
  misc_feature (1)..(1299): Ceres CLONE ID no.325346
  misc_feature (1)..(1299): useful for making plants with altered flowering time as described in USSN 12/281,616
acacaagcagcaacatcactgatcgccgtgcagcctggtacgtaccacacacacacacacacatacagaagaagaacgtaccttgcgctacaaccccgtcgccgccgactacgccgatcgtgtccacgggaaccaagcaaagcaaagcaagcgacgcatcggaagaagccggagaccgaccgaccgaccgagctacctagctacagctcatcagcccatggtgaagacggcgacggcgacggcggcggcgaggcacggcggcgctcataagaggacgtacaagggcgtgcggatgcggagctggggctcctgggtgtcggaggtgcgggcgccgggccagaagacgaggatmtggytsggctcccactccaccgccgaggccgcggcgcgcgchtacgacgccgcgctgctctgcctcaggggctcggcggccgcgccggacctcaacttcccgccccgccgcccgctcgccgacggcctccacccgctgccccccgccgccatgtcgcccaaggccatccagcgcgtggccgccgccgccgcggcctgctgcgctcctcagagtaacggcattggcagtgcctgctgcgccgcgccctgcgctcctccgagtaatggcattggcagcgcctgcggccacgccgagaccgccccggcgttgagcggcagcccgccctccagcgacagcgacgtctcctccccggaggcggggtccaccgccagcagcgacggcgagctggcccgctacggcgacggcgacggcgacggcggcgtcagcgtggactacggctcgctcgccgacatcgacgccttcttccagtcgcccaagtgcatggacgacgaccactactactmcgcagcgctcatggacccctgcggcgccttcttcgcgccggcgccatcggttgcggcggacgacgacgcagcagccgccgccggatgctgggaggacggcgacggcattgcgctctggagcttcagcttccccgctctggactgctgagctgaagcggcgcagattccgctactactgacgattgacgactaatcgccggtcaagcgatggaaaccgctttatttgcttcatcgacggcacaggtttccgcatacatgataaatttacccaatttaattcgatgtatgtaaacattcttaataagctgattgttaagcgttgtagtggtggggagctctcatggctgaagctgcatgttttaaggtagctttttccatggagttaacctctttgctattgcttgtctatgagtaaacaaaaaaaaaaacagttttattgccagc

SEQ ID NO: 8011 - protein, 261 aa, Zea mays
  misc_feature (1)..(261): Ceres CLONE ID NO.325346
  misc_feature (19)..(84): Pfam Name: AP2 Pfam Description: AP2 domain
  misc_feature (1)..(261): Functional Homolog of  Ceres CLONE NO.708396 with e-value of 7.00E-27 and BLAST sequence identity of 60.3
  misc_feature (45)..(45): Xaa is any aa, unknown, or other
  misc_feature (47)..(47): Xaa is any aa, unknown, or other
  misc_feature (59)..(59): Xaa is any aa, unknown, or other
  misc_feature (213)..(213): Xaa is any aa, unknown, or other
  misc_feature (1)..(261): useful for making plants with altered flowering time as described in USSN 12/281,616
MVKTATATAAARHGGAHKRTYKGVRMRSWGSWVSEVRAPGQKTRXWXGSHSTAEAAARXYDAALLCLRGSAAAPDLNFPPRRPLADGLHPLPPAAMSPKAIQRVAAAAAACCAPQSNGIGSACCAAPCAPPSNGIGSACGHAETAPALSGSPPSSDSDVSSPEAGSTASSDGELARYGDGDGDGGVSVDYGSLADIDAFFQSPKCMDDDHYYXAALMDPCGAFFAPAPSVAADDDAAAAAGCWEDGDGIALWSFSFPALDC

SEQ ID NO: 8012 - DNA, 1182 bp, Triticum aestivum
  misc_feature (1)..(1182): Ceres CLONE ID no.617383
  misc_feature (1)..(1182): useful for making plants with altered flowering time as described in USSN 12/281,616
agaccagtgagcgcagcacacagatcagcactcaacaacaagccttgcgttgcaaaccatcgaccgaaggaaccgactgagctaagaggaggttcgccgagaagctagccgtgcgtagcaatggtgaagactgcggcagctgggagcactggcgatggcgccgtggcagcgaagcagcagcagcttggcggcaagatgaggacgtacaagggcgtgcggatgaggagctggggcgcgtgggtgtcggagatccgggcgcccgggcagaagacgcggatatggctcggctcccactccaccgccgaggccgccgcgcgcgcctacgacgccgcgctgctctgcctcaagggcgcctccgccgccgccgacctcaacttccccgtgcgcttccccttcgacctccccgccgccgccatgtcgcccaagtccatccagcgcgtcgccgcagccgccgccgccggggccagcgctaatgtgttcgacttcgccgctgccgacgacagtgccagcgctaatgccgtcgacttcgccggtgccgacgacagcgccagcgcggtcacccccgagtactgcagctcctccagcaatgcctcgccggtgagctctccggagacggcaagcagtggcggcgccgacctcgacggcgtagacctcctgggttacggttacagccagtgctcgctcgcggaaatcgaggccttcttccagtcgcccaagtgcatggagtacgccatgatggacccgtgcagcaccttcttcgctccggcgccgatagcaatggaggacgagtgcagctgggaggaaggaggcgacattgcgctctggagctactgaaccggagtccgggaagccggagaaccgaagaaactgacaaatcgttactcaagcgaaggccagaactggccatgcatggtgataactatccttaatttcatatatgtggtaaattaattcgattcattgtacacaacaacaataaggtagttgagcgttgtgggggggagctctcatggagctacatgttttaaggcagcttccatggagttaacctcccttcaattgcttgttacatccgtgttaaaaaagctgctttgcaattgcaagcatatatttcctttgaaaaaaaaaaaaaaaaaaaaaaaaaaaaaaaaaaaaaaaaaaaaaaaaaaaaaaaaaaaaaaa

SEQ ID NO: 8013 - protein, 237 aa, Triticum aestivum
  misc_feature (1)..(237): Ceres CLONE ID NO.617383
  misc_feature (27)..(92): Pfam Name: AP2 Pfam Description: AP2 domain
  misc_feature (1)..(237): Functional Homolog of  Ceres CLONE NO.708396 with e-value of 1.39E-28 and BLAST sequence identity of 56.7
  misc_feature (1)..(237): useful for making plants with altered flowering time as described in USSN 12/281,616
MVKTAAAGSTGDGAVAAKQQQLGGKMRTYKGVRMRSWGAWVSEIRAPGQKTRIWLGSHSTAEAAARAYDAALLCLKGASAAADLNFPVRFPFDLPAAAMSPKSIQRVAAAAAAGASANVFDFAAADDSASANAVDFAGADDSASAVTPEYCSSSSNASPVSSPETASSGGADLDGVDLLGYGYSQCSLAEIEAFFQSPKCMEYAMMDPCSTFFAPAPIAMEDECSWEEGGDIALWSY

SEQ ID NO: 8014 - DNA, 1299 bp, Triticum aestivum
  misc_feature (1)..(1299): Ceres CLONE ID no.910527
  misc_feature (1)..(1299): useful for making plants with altered flowering time as described in USSN 12/281,616
gcaccagccacacacccaaccaaccacccctagctaccacttcaacctgcactggtctctgcacactctcggagttcagcgtcgctcgcagatcaaagaagtcaagttcgtgtcacagcgaggagcgtcgtcggtgagcgtgatcggtcgggaaatggtgaagagcgcgcagcagcagccgcagggggggctcggcggcgacggcggcaatgcggtggcggcgaggcagggcggcggcggcggcgggaggcagcagcagcagcagtacaagggcatgcggatgcggagctgggggtcgtgggtgtcggagatccgggcgcccaaccagaagacgcgcatatggctcggctcctactccaccgccgaggccgccgcgcgcgcctacgacgccgcgctgctctgcctccggggctccgccgccgacctcaacttccccgtgcacctccccttccacgtccccgccggcgccatgtcgcccaagtccatccagcgcgtcgccgctgccgccgccgccagtgccagcagcagccccctgcagcctccccacaccatggcctcctctgcctcctggcccggcgccgccccgccgtgcggctacggcgacaacgcgtcgtccttcggctccccagaggaccggtccgcccgccacagcaacgccgacgacgacgagaccatggcgcacggcgacgacggcgtggactacgacgcgctggcggacatcgacgccttcttccagtcgcccaagtgcatggactacgccatgatgatggacccgtgcagcaccttcttcgcgccggcgcccatggcgcccgtcgagtgggaggaggaaggcgagatcagcctctggagcttctcctcctacaactgatcgagctcaaatgccagctccgaccgagagcttcgagcttcgagcttcgactggccatggaggccatttcatgcttcgactggtcaaatcaccactaagcaattccatcaacactgacagattaattactcaactaccactacgagtgaccaagaattggtcacggtaaaaataatcgcaggccatgatcaattcttacttcatggcctcgcgaagaatgatgattaattattatttcattcatattccgtagctaaatataatatactagtaccactggcgtactagtagtacgtatccgtacaaggccaattatgcatttgtgggggaggtctgatggagctacatgttttaaggcagcttccatggagccaactcccttcaattagtttacatgtgtactagtatgtgtaagaaaaaaaaaaaaaaaa

SEQ ID NO: 8015 - protein, 237 aa, Triticum aestivum
  misc_feature (1)..(237): Ceres CLONE ID NO.910527
  misc_feature (36)..(99): Pfam Name: AP2 Pfam Description: AP2 domain
  misc_feature (1)..(237): Functional Homolog of  Ceres CLONE NO.708396 with e-value of 1.29E-32 and BLAST sequence identity of 49.4
  misc_feature (1)..(237): useful for making plants with altered flowering time as described in USSN 12/281,616
MVKSAQQQPQGGLGGDGGNAVAARQGGGGGGRQQQQQYKGMRMRSWGSWVSEIRAPNQKTRIWLGSYSTAEAAARAYDAALLCLRGSAADLNFPVHLPFHVPAGAMSPKSIQRVAAAAAASASSSPLQPPHTMASSASWPGAAPPCGYGDNASSFGSPEDRSARHSNADDDETMAHGDDGVDYDALADIDAFFQSPKCMDYAMMMDPCSTFFAPAPMAPVEWEEEGEISLWSFSSYN

SEQ ID NO: 8016 - DNA, 1014 bp, Triticum aestivum
  misc_feature (1)..(1014): Ceres CLONE ID no.1048424
  misc_feature (1)..(1014): useful for making plants with altered flowering time as described in USSN 12/281,616
gtgtggtgtggcagcaagatctcatctccgcagcagggagctatagcgcgtggaaaatggtcaagaaccacccgggcagcggcactagcaggtgcgacgctgcggcggctatggcagagagcggtggtgggggtgggacggcagcgctgtgcggcggcgggagtaggcagccggcgatggcggcgaggcagttcaagggggtgcggatgcggagctgggggtcgtgggtgtcggagatcagggcgccgcaccagaagcgccggatctggctcggctcctacgccaccccggaggccgccgcgcgcgcctacgacgccgcgctcctctgcctcaagggctccgacgccgtcctcaacttcccctcgtcgtcctccgcctcaccctcgtcgccgcattcgcttccctcccccgccaatcgacacgccgacgacctgtccccgaggtccatccagcgcgcggccgccgctgcggcagcggccttcgaggccaccaggatcgtcgtggacgacagctgctcttccagcgcggaggcgacgacgccgacctcgttctcagtgtccacgctggggagcgccgacgtccaggagcacgccacgtcttcgatgtccgccgcggccagcactggctcgccggtgggagatcaggacgagctgtggacggagctggacgcgttcgcgtcccccaagctcatggacctcatcgccgccggtcacgccacgcccttctcttgcacctgggaggagcccgaggaggacggcgacatgatgaggctctggagcttctgctagagtgaagcgtccatcgtctgcagtgggtcgacattgatatgcgcatccatgagtcgatcgccattgatcattggttttttctatctcccatggaggctagctaggtgcatgcatggatcctctctactaggctctagctaggtctcactccaagtctgcttccatagattctttctttcatttagtaagaacataatacttatacaatataaaaaaaaaaaaaaaa

SEQ ID NO: 8017 - protein, 243 aa, Triticum aestivum
  misc_feature (1)..(243): Ceres CLONE ID NO.1048424
  misc_feature (44)..(107): Pfam Name: AP2 Pfam Description: AP2 domain
  misc_feature (1)..(243): Functional Homolog of  Ceres CLONE NO.708396 with e-value of 3.50E-32 and BLAST sequence identity of 52.1
  misc_feature (1)..(243): useful for making plants with altered flowering time as described in USSN 12/281,616
MVKNHPGSGTSRCDAAAAMAESGGGGGTAALCGGGSRQPAMAARQFKGVRMRSWGSWVSEIRAPHQKRRIWLGSYATPEAAARAYDAALLCLKGSDAVLNFPSSSSASPSSPHSLPSPANRHADDLSPRSIQRAAAAAAAAFEATRIVVDDSCSSSAEATTPTSFSVSTLGSADVQEHATSSMSAAASTGSPVGDQDELWTELDAFASPKLMDLIAAGHATPFSCTWEEPEEDGDMMRLWSFC

SEQ ID NO: 8018 - protein, 238 aa, Oryza sativa
  misc_feature (1)..(238): Public GI ID NO.50913131
  misc_feature (32)..(95): Pfam Name: AP2 Pfam Description: AP2 domain
  misc_feature (1)..(238): Functional Homolog of  Ceres CLONE NO.708396
  misc_feature (1)..(238): useful for making plants with altered flowering time as described in USSN 12/281,616
MVKSGQEAAPGSGGNAAAAAARQGGGGGGRGRQYKGVRMRSWGSWVSEIRAPNQKTRIWLGSYSTAEAAARAYDAALLCLKGSAADLNFPVHLPFHIPAAAMSPKSIQRVAAAAAANATSPLQHHSGAPSFATATGGYNPAAAPTTPPCSYGDMSSCSAVSSPETANYYGADHDMVAREDDVDYAALADIDAFFQSPKCMDYSMMDPCSTFFSPAPESLAAEWEDEGEISLWSFSSLN

SEQ ID NO: 8019 - protein, 230 aa, Arabidopsis thaliana
  misc_feature (1)..(230): Public GI ID NO.6552733
  misc_feature (48)..(111): Pfam Name: AP2 Pfam Description: AP2 domain
  misc_feature (1)..(230): Functional Homolog of  Ceres CLONE NO.708396
  misc_feature (1)..(230): useful for making plants with altered flowering time as described in USSN 12/281,616
MVKQERKIQTSSTKKEMPLSSSPSSSSSSSSSSSSSSCKNKNKKSKIKKYKGVRMRSWGSWVSEIRAPNQKTRIWLGSYSTAEAAARAYDVALLCLKGPQANLNFPTSSSSHHLLDNLLDENTLLSPKSIQRVAAQAANSFNHFAPTSSAVSSPSDHDHHHDDGMQSLMGSFVDNHVSLMDSTSSWYDDHNGMFLFDNGAPFNYSPQLNSTTMLDEYFYEDADIPLWSFN

SEQ ID NO: 8020 - protein, 231 aa, Arabidopsis thaliana; identical to SEQ ID NO: 8009
  misc_feature (1)..(231): Public GI ID NO.21554056
  misc_feature (49)..(112): Pfam Name: AP2 Pfam Description: AP2 domain
  misc_feature (1)..(231): Functional Homolog of  Ceres CLONE NO.708396 with e-value of 5.80E-39 and BLAST sequence identity of 59.2
  misc_feature (1)..(231): useful for making plants with altered flowering time as described in USSN 12/281,616

SEQ ID NO: 8021 - DNA, 976 bp, Arabidopsis thaliana
  misc_feature (1)..(976): Ceres CLONE ID no.231890
  misc_feature (1)..(976): useful for making plants with altered flowering time as described in USSN 12/281,616
agaatacttttatctcatattcccaacacttgttcaagcatatctaagtcaataacaacattacaacataacatggtgaaacaagaactcaagatccaagttactacttcctcatcatcactctctcattcttcatcttcttcttcttcttcaacgtcggcactacgtcatcaatcttgtaagaacaagataaagaagtataaaggtgtgaggatgcgaagttggggatcatgggttactgaaattagggcaccaaatcaaaagacaagaatctggttaggttcttactccaccgcagaagcagctgctagggcttacgacgctgctctcttgtgtcttaagggacctaaagctaatctcaacttccctaacatcaccactacttctccttttcttatgaacatcgacgaaaagacccttttgtccccaaaatcaatccaaaaggtcgccgctcaagccgctaactcctcttctgaccattttacccctccgtccgatgaaaatgatcatgatcatgaagacggactcgatcaccatccatctgcttcttcttcagctgcatcttcaccaccagatgatgatcatcataatggatgacgatgggtgatttggtatcgktgatggaatctttcgkgggattaccaacgaacaccgtgkctytggatgggatccatcgctgkatggaaatttggacataatgagatcttcttcaccaacggagatccgtttgattattctccacagttacatagctcaaaggcaacgatggatgacttctacgacgatgttgatattccgctgtggagtttcagttaatccaacggtccatattattatactacgaaacacttttaattcacattatttcatttaatttattctttcaattcatattattcgtccttgttgtttcgttatgtattaaatatacacacactaatttaagaagatcacatggactagaggtttttttgtc

SEQ ID NO: 8022 - protein, 79 aa, Arabidopsis thaliana
  misc_feature (1)..(79): Ceres CLONE ID NO.231890
  misc_feature (41)..(104): Pfam Name: AP2 Pfam Description: AP2 domain
  misc_feature (1)..(79): Functional Homolog of  Ceres CLONE NO.708396 with e-value of 2.10E-18 and BLAST sequence identity of 75.3
  misc_feature (1)..(79): Functional Homolog of  Ceres CLONE NO.231890 with e-value of 1.60E-41 and BLAST sequence identity of 53.3
  misc_feature (1)..(79): Functional Homolog of  Ceres CLONE NO.100156 with e-value of 8.60E-24 and BLAST sequence identity of 78.2
  misc_feature (79)..(79): Xaa is any aa, unknown, or other
  misc_feature (1)..(79): useful for making plants with altered flowering time as described in USSN 12/281,616
MVKQELKIQVTTSSSSLSHSSSSSSSSTSALRHQSCKNKIKKYKGVRMRSWGSWVTEIRAPNQKTRIWLGSYSTAEAAX

SEQ ID NO: 8023 - DNA, 987 bp, Arabidopsis thaliana
  misc_feature (1)..(987): Ceres CLONE ID no.100156
  misc_feature (1)..(987): Ceres LOCUS ID At1g21910
  misc_feature (1)..(987): useful for making plants with altered flowering time as described in USSN 12/281,616
atcaaaaaatctctatccatccacaacaacaacaaaaactcaagaacaatatctccacttgatcactaccacattgtccaatcactctacaaagcctgtacgtacacaacaacattaccatggtgaaacaagaacgcaagatccaaaccagcagcacaaaaaaggaaatgcctttgtcatcatcaccatcttcttcttcttcttcatcttcttcctcgtcttcgtcttcgtgtaagaacaagaacaagaagagtaagattaagaagtacaaaggagtgaggatgagaagttggggatcatgggtctctgagattagggcaccaaatcaaaagacaaggatttggttaggttcttactcaacagctgaagcagctgctagagcttacgatgttgcactcttatgtctcaaaggccctcaagccaatctcaacttccctacttcttcttcttctcatcatcttcttgataatctcttagatgaaaatacccttttgtcccccaaatccatccaaagagtagctgctcaagctkccaactcatttaaccatttttgcccctacttcatcaggccgtctcgtcaccgtcccgatcatgatcatcaccatgatgatgggatgcaatctttgrtgggatctttttggkggacaatcatgtgtctttgatggattcaacatcttcatggtatgatgatcataatgggatgttcttgtttgataatggagctccattcaattactctcctcaactaaactcgacgacgatgctcgatgaatacttctacgaagatgctgacattccgctttggagtttcaattaatccgacggtccataatacatactttaattagttttctaaatcattttttaaattcttttttatatatgtaacatatatttaccctcgtcgtaattattcatttccaagttgtttgttgcttggagagaattgacgacggatacgattatataatataattgtaagttttt

SEQ ID NO: 8024 - protein, 230 aa, Arabidopsis thaliana; identical to SEQ ID NO: 8019
  misc_feature (1)..(230): Ceres CLONE ID NO.100156
  misc_feature (1)..(230): Ceres LOCUS ID At1g21910
  misc_feature (48)..(111): Pfam Name: AP2 Pfam Description: AP2 domain
  misc_feature (1)..(230): Functional Homolog of  Ceres CLONE NO.708396 with e-value of 3.60E-39 and BLAST sequence identity of 59.2
  misc_feature (1)..(230): Functional Homolog of  Ceres CLONE NO.231890 with e-value of 1.60E-41 and BLAST sequence identity of 53.3
  misc_feature (1)..(230): Functional Homolog of  Ceres CLONE NO.100156 with e-value of 8.60E-24 and BLAST sequence identity of 78.2
  misc_feature (1)..(230): useful for making plants with altered flowering time as described in USSN 12/281,616

SEQ ID NO: 8025 - DNA, 1031 bp, Zea mays
  misc_feature (1)..(1031): Ceres CLONE ID no.285154
  misc_feature (1)..(1031): useful for making plants with altered flowering time as described in USSN 12/281,616
aggtctctagtctccactccgctgtcgctccggcccagcagctcgaccaccaccgctccgcaggcaggaagccgccaaggacatggacgacgctcaggagcctccctcccctccctccccctcgcagtcatcctcctcctcttcctcgtcgtcctccgtggccccgaacccgaagaagcgggcgcgcaaggacggcagccggcacccgacgtaccgcggcgtgcgcatgcggagctggggcaagtgggtgtcggagatcagggagccccgcaagaagtctcgcatctggctgggcaccttcgccaccgcggagatggcggcgcgcgcgcacgacgtggccgcgctcgccatcaagggcgcgcgcgacgcgcacctcaacttcccgggcctcgcgcacctgctcccgcgcccggccaccgcggcgcccaaggacgtgcaggccgcggccgcgctcgccgcggccgccgacttccctctgccgccgtcccccggcggcgccaatgccaagagccccgagagcagcagctccggctccgcctccgcctccgcctcctgacgacgccagcgccgcctcgccggcggcgccgcaggacgccgagcccaacccggacgacgcgctgttcgacctcccggacctgcttctggacctgagatgctgcgggccgtcgtcgtgggccgtcgacgacgacgtggccggcggcggcgcgttccggatcatcgaggagccgctgctgtgggagtactgaactgatcaatgccaccgcgccagtcctgtccttgagcggttggcagtgatcagcgagttcatgcatcggtagctgttgagtgttagatcgaccggacggacacatgtaaatgcagctccttccgctcctctgtttcgtgctctggattactctgctgtttcttctctttatgccagatttaggtgccgcgcttgtataaagttagttcctttttttccctccttctcttgcttgatttggaagacaagaatatgtataaccataagaagcatcttatcttgtgcc

SEQ ID NO: 8026 - protein, 220 aa, Zea mays
  misc_feature (1)..(220): Ceres CLONE ID NO.285154
  misc_feature (42)..(106): Pfam Name: AP2 Pfam Description: AP2 domain
  misc_feature (1)..(220): Functional Homolog of  Ceres CLONE NO.708396
  misc_feature (1)..(220): Functional Homolog of  Ceres CLONE NO.231890 with e-value of 1.60E-41 and BLAST sequence identity of 53.3
  misc_feature (1)..(220): Functional Homolog of  Ceres CLONE NO.100156 with e-value of 8.60E-24 and BLAST sequence identity of 78.2
  misc_feature (1)..(220): useful for making plants with altered flowering time as described in USSN 12/281,616
MDDAQEPPSPPSPSQSSSSSSSSSSVAPNPKKRARKDGSRHPTYRGVRMRSWGKWVSEIREPRKKSRIWLGTFATAEMAARAHDVAALAIKGARDAHLNFPGLAHLLPRPATAAPKDVQAAAALAAAADFPLPPSPGGANAKSPESSSSGSASASASDDASAASPAAPQDAEPNPDDALFDLPDLLLDLRCCGPSSWAVDDDVAGGGAFRIIEEPLLWEY

SEQ ID NO: 8027 - protein, 238 aa, Oryza sativa subsp. japonica; identical to SEQ ID NO: 8018
  misc_feature (1)..(238): Public GI ID NO.46805442
  misc_feature (1)..(238): Functional Homolog of  Ceres CLONE NO.708396 with e-value of 4.30E-34 and BLAST sequence identity of 47.7
  misc_feature (1)..(238): Functional Homolog of  Ceres CLONE NO.231890 with e-value of 1.60E-41 and BLAST sequence identity of 53.3
  misc_feature (1)..(238): Functional Homolog of  Ceres CLONE NO.100156 with e-value of 8.60E-24 and BLAST sequence identity of 78.2
  misc_feature (1)..(238): useful for making plants with altered flowering time as described in USSN 12/281,616

SEQ ID NO: 8028 - DNA, 783 bp, Arabidopsis thaliana
  misc_feature (1)..(783): Ceres ANNOT ID no.543998
  misc_feature (1)..(783): Ceres LOCUS ID At1g21340
  misc_feature (1)..(783): useful for making plants with altered flowering time as described in USSN 12/281,616
atgttgccgtacattggacacaacagctaccagcagcaccagtttccgttgccggagatggaaattccggagaagtggaagctttcttacgaacaagaggctattactgctccggcttgtcctcgttgtgcatcgtccaacaccaagttttgttattacaacaactacagcttgtctcagcctagatacttctgcaagggttgccgtcgttactggacgaaaggcggttctctccgcaacattcctgtaggtggaggctgtcgcaagagaagtcgaagcagacagaacagtcacaaaaggtttggccggaacgagaatcggccagatggtcttattaaccaagatgatggattccagtccagccctcctggttctgatattgatttggctgcggttttcgcacaatatgtgactgatcggagcccttctagtacagataatactactggatccgatcaagattcaccgataacaacaaccactcatgctttagaatctttgagttgggatatctgccaagaaactgatgtggatcttggattctacggggaattcaataatctaactcagaagaccaaagaggatcaagaagtatttggtcagtttctccaagaagatcgagaggagatcttcgagttccagggtttactcgatgacaaagagattcaagagatcctggaatgctcattctcagaggagccagaccagttagtttctcaggggagcttcatgatcaatggtgataactggagttcaacagatcttaccaggttcgggatttga

SEQ ID NO: 8029 - protein, 260 aa, Arabidopsis thaliana
  misc_feature (1)..(260): Ceres ANNOT ID NO.543998
  misc_feature (1)..(260): Ceres LOCUS ID At1g21340
  misc_feature (33)..(95): Pfam Name: zf-Dof Pfam Description: Dof domain, zinc finger
  misc_feature (1)..(260): Functional Homolog of  Ceres ANNOT NO.543998
  misc_feature (1)..(260): useful for making plants with altered flowering time as described in USSN 12/281,616
MLPYIGHNSYQQHQFPLPEMEIPEKWKLSYEQEAITAPACPRCASSNTKFCYYNNYSLSQPRYFCKGCRRYWTKGGSLRNIPVGGGCRKRSRSRQNSHKRFGRNENRPDGLINQDDGFQSSPPGSDIDLAAVFAQYVTDRSPSSTDNTTGSDQDSPITTTTHALESLSWDICQETDVDLGFYGEFNNLTQKTKEDQEVFGQFLQEDREEIFEFQGLLDDKEIQEILECSFSEEPDQLVSQGSFMINGDNWSSTDLTRFGI

SEQ ID NO: 8030 - DNA, 933 bp, Oryza sativa
  misc_feature (1)..(933): Ceres ANNOT ID no.1381104
  misc_feature (1)..(933): useful for making plants with altered flowering time as described in USSN 12/281,616
atgatggcaggagctcccccgatgcatatctgcatggactccgactggctcaagggcatcgtccccgaggagcacgggatggggtcgtcgtcgccgtcggcggagctgatcgcgtgcccgcgggcgccgatgcaggcggcggcggcggcggccgaccgccggcttcgcccccagcacgaccagccgctcaagtgcccgcggtgcgagtcgacgcacaccaagttctgctactacaataactacagcctctcgcagccgcgctacttctgcaagacgtgccgccgctactggaccaagggcggctcgctccggaacgtccccgtcggcggcggctgccgcaagaacaagcgcgcgccgcccaagaaggccgccgcccacgcccagcccgcggtggcggtggcggcggcgctgcaaggccgccacatggagaccggactccacctgtccttctccgggatgcagcatcatcttgcgccgccgccgccggcggcggccaccgcggccgacccgctctgcagccttggactatttgactggaagcagtacgaccccgtcttcgccggctccggtggcggcggctcccccgtggcggcgctggagagcgctggtggctcggaggcgcagttcatgggtgctggcatgatgggcattggcggcggcggcgtcgcggagtaccatgcgctgagcgcgctccggttcgcggcagggctcggcgatcacctggcgctgccgttcggcgcggtgcgggcggagcacgacgccgtcgaggtgaagccggtggcggcggagaggctgctgtcgctcgagtggtgcggcgaggcgagccgcacggcggcgccggagagctccattagctcgctgggcgggctgggactgtggagcggcatgatcggcggcgggcaccatcaccatggctcctccgctgccatctga

SEQ ID NO: 8031 - protein, 310 aa, Oryza sativa
  misc_feature (1)..(310): Ceres ANNOT ID NO.1381104
  misc_feature (1)..(310): Functional Homolog of  Ceres ANNOT NO.543998
  misc_feature (1)..(310): useful for making plants with altered flowering time as described in USSN 12/281,616
MMAGAPPMHICMDSDWLKGIVPEEHGMGSSSPSAELIACPRAPMQAAAAAADRRLRPQHDQPLKCPRCESTHTKFCYYNNYSLSQPRYFCKTCRRYWTKGGSLRNVPVGGGCRKNKRAPPKKAAAHAQPAVAVAAALQGRHMETGLHLSFSGMQHHLAPPPPAAATAADPLCSLGLFDWKQYDPVFAGSGGGGSPVAALESAGGSEAQFMGAGMMGIGGGGVAEYHALSALRFAAGLGDHLALPFGAVRAEHDAVEVKPVAAERLLSLEWCGEASRTAAPESSISSLGGLGLWSGMIGGGHHHHGSSAAI

SEQ ID NO: 8032 - DNA, 894 bp, Populus balsamifera subsp. trichocarpa
  misc_feature (1)..(894): Ceres ANNOT ID no.1467548
  misc_feature (1)..(894): useful for making plants with altered flowering time as described in USSN 12/281,616
atggatactgctactcagtgggcacaggggattggtgctgttaatccaatggaaggttcaaggcctgatgtgttagagagaagggcaagggctcaaaaggatcaagctttgaattgtccaaggtgcaattccactaataccaaattttgttactacaacaactatagtctttctcagccaaggtacttttgcaagacttgtagaaggtattggactgcaggtgggtctttaagaaatgttccagttggtggtggttcaagaaagaacaagaggtcatcaagtactgcatcaacatcagcagcaggagcagctgcttcaaagaagtttcctcttgatctgacccagccaaatctcccccattcagcttctcaaaaccctaagatccatgaaggtcaagatctaaatctagcttaccccccatcagctgacgattatagtaatttgtctgagtttgttgagataccttttgatactgaaagcaacaaaacccaccatcaaaaccctaatccttcaagtacatctccctctcatcatcatcatcatcacgtctcacccatggagtttctcaagagtactgccatgaattcaagaggatttagtgctttcatgtcaattccaccactatccgattcaaacaacaccatgttttcaactgggtttcctttacaagaattcaagtcaactcagaatttttctttagaagggcttgaaagtgggtatagtaacactcaaggggtgcacgagacttgtggtagtgcaaggcttttgtttcctatagaagacttgaagcaacaagttccaagcaatactgaatttgaacagaataccagagagcaaagagataatgctccagttgggtattggaatggaatgttaggtggtggatcatggtaa

SEQ ID NO: 8033 - protein, 297 aa, Populus balsamifera subsp. trichocarpa
  misc_feature (1)..(297): Ceres ANNOT ID NO.1467548
  misc_feature (32)..(94): Pfam Name: zf-Dof Pfam Description: Dof domain, zinc finger
  misc_feature (1)..(297): Functional Homolog of  Ceres ANNOT NO.543998 with e-value of 1.20E-22 and BLAST sequence identity of 85.1
  misc_feature (1)..(297): useful for making plants with altered flowering time as described in USSN 12/281,616
MDTATQWAQGIGAVNPMEGSRPDVLERRARAQKDQALNCPRCNSTNTKFCYYNNYSLSQPRYFCKTCRRYWTAGGSLRNVPVGGGSRKNKRSSSTASTSAAGAAASKKFPLDLTQPNLPHSASQNPKIHEGQDLNLAYPPSADDYSNLSEFVEIPFDTESNKTHHQNPNPSSTSPSHHHHHHVSPMEFLKSTAMNSRGFSAFMSIPPLSDSNNTMFSTGFPLQEFKSTQNFSLEGLESGYSNTQGVHETCGSARLLFPIEDLKQQVPSNTEFEQNTREQRDNAPVGYWNGMLGGGSW

SEQ ID NO: 8034 - DNA, 1482 bp, Zea mays
  misc_feature (1)..(1482): Ceres CLONE ID no.445231
  misc_feature (1)..(1482): useful for making plants with altered flowering time as described in USSN 12/281,616
atctctccaccaaccggcggcaccaccagattcctctcttgctctgctctagcttcttctagctagccccctccttcgcaccacgcactattatctcatccgttcttccttcagtctatgtttatttgctctgcacatcatcgctcggtggccctgtcctcgctaccttccaattagtcggcaaggcaaaggcaccggcagagaggaagaaggccagttctatagtatatatgacgatcagggtaatgaattagctaccggctgcacagttttgtgggggtgtgtccgcgtggtgtgttgtgtgtgtctagctagctaggttttgcgtgtggctcgtcgatctgcttggcagaacagacctcgatcgtcgtcacgtttggccgacgtattctgatgatggccggggcaccgccgatgcacatctgcctggactcggactggctcaagggcatcgttcccgaggagcctgggatgggatcgtcgtcaccgtcagcggagctgatcgcgtgccctaggccaatgcacgccacggctgccgcggcggaccggcgtctgcgcccgcagcacgaccagccactcaagtgcccgcgatgcgagtccacgcacaccaagttctgctactacaacaactacagtctctcccagccgcgctacttctgcaagacgtgccgccgctactggaccaaaggcggatcgctccgcaacgtcccggttggtgggggatgccgcaagaacaagcgcgccagcgccaagaaaccccccgcgccaccgatgcagccgccgcacatgtcggagacgggcctccacctgtccttctccggcgtgcagcagctgccgccggccgatccgctttgcagcctcggccttttggactggaagtacgacccgatcctcacaggttccggtggcgtcgctggctcgttggatggcgccagctccgagacgcacttcgcagggacgggcatgctgggcatcccaggtgccagcgggggcggcgagtgccacgcgctgagcgcgctcaggtacgcggccggcctgggcgagaacctgcaggtgcagggtctcccgtttggggcgcgcgctgagcacgacgcgatggagatgaagcctgcggcgacggataggctgctctcgctggactggtacagcgagacaagccgcgcgccagagagcgccatcagctcgttgggcgcgctgggcctgtggagcggcatgctcggcggtgcgcaccagcaccatggctcgtcggcggccatctaagaccctagcaaaacgtgcctccatgcttgcgttgcattgcaccagtttgctaatggcgttaacaagtatgagtgactacgtagaaatgcttgtttttttacctgtttttatcttctgtttcgtttcgtcgtttgttttttggacgatccatgtttgccgctcgtcatttcagatgatgtctcttgttgtaccgcttcaaagttcaaacacttgctgtggttc

SEQ ID NO: 8035 - protein, 288 aa, Zea mays
  misc_feature (1)..(288): Ceres CLONE ID NO.445231
  misc_feature (57)..(119): Pfam Name: zf-Dof Pfam Description: Dof domain, zinc finger
  misc_feature (1)..(288): Functional Homolog of  Ceres ANNOT NO.543998 with e-value of 1.29E-23 and BLAST sequence identity of 85.1
  misc_feature (1)..(288): useful for making plants with altered flowering time as described in USSN 12/281,616
MMAGAPPMHICLDSDWLKGIVPEEPGMGSSSPSAELIACPRPMHATAAAADRRLRPQHDQPLKCPRCESTHTKFCYYNNYSLSQPRYFCKTCRRYWTKGGSLRNVPVGGGCRKNKRASAKKPPAPPMQPPHMSETGLHLSFSGVQQLPPADPLCSLGLLDWKYDPILTGSGGVAGSLDGASSETHFAGTGMLGIPGASGGGECHALSALRYAAGLGENLQVQGLPFGARAEHDAMEMKPAATDRLLSLDWYSETSRAPESAISSLGALGLWSGMLGGAHQHHGSSAAI

SEQ ID NO: 8036 - protein, 299 aa, Oryza sativa subsp. japonica
  misc_feature (1)..(299): Public GI ID NO.19387252
  misc_feature (1)..(299): Functional Homolog of  Ceres ANNOT NO.543998 with e-value of 1.29E-23 and BLAST sequence identity of 85.1
  misc_feature (1)..(299): useful for making plants with altered flowering time as described in USSN 12/281,616
MDSDWLKGIVPEEHGMGSSSPSAELIACPRAPMQAAAAAADRRLRPQHDQPLKCPRCESTHTKFCYYNNYSLSQPRYFCKTCRRYWTKGGSLRNVPVGGGCRKNKRAPPKKAAAHAQPAVAVAAALQGRHMETGLHLSFSGMQHHLAPPPPAAATAADPLCSLGLFDWKQYDPVFAGSGGGGSPVAALESAGGSEAQFMGAGMMGIGGGGVAEYHALSALRFAAGLGDHLALPFGAVRAEHDAVEVKPVAAERLLSLEWCGEASRTAAPESSISSLGGLGLWSGMIGGGHHHHGSSAAI

SEQ ID NO: 8037 - DNA, 1700 bp, Triticum aestivum
  misc_feature (1)..(1700): Ceres CLONE ID no.770468
  misc_feature (1)..(1700): useful for making plants with altered flowering time as described in USSN 12/281,616
catccggttggggctttggccatggctccgctgcttttcgctcccttcttattcacatctcccccctccacgtctctcaccaactaccagtagcaccgcagcccaccagcttcgctgcctcatatctcctcttccttctccatagcctctcttctcctgtccagtatctctgcgtcgatccaccccgccctcctcttcatcttcatgttcttcctagctaatcggtgaatccgcctcctcttagctaaccaatcgcccttaaacccgtcgacaaaataacgaaacgagaacaagcaggccgcgtgcgtgtgcagtaggtgtagaccatcgatcgtatctaggtttgagttgctgctggatcttggatttgccggagttacgtgcgtagctagccgctggcggtgaggttaccgcatctttggggtgccttgactggttgatcgatcgggaagcccgggcgatcgatgatggcaggcgcagctcatccgatgcatttctgcatggactccgactggctcaagggcatcgtccccgaggaccagggagggatggggtcgtcgtcgccgtcgggggagctgatcatcgcgtgcccggagccgatgcaggcccagcaggcggcggaccggcggctgcgcccgcagcacgaccagccgctcaagtgcccgcgctgcgactccacgcacaccaagttctgctactacaacaactacagcctctcccagccccgctacttctgcaagacgtgccgccgctactggaccaagggcggctccctccgcaacgtccccgtcggcggcggctgccgcaagaacaagcgcgccagcgccgccaagaagccctcggctgccgccgccatcgcgccgccgatttcgatgatgcagcagcttcatcacggccggcacatggcggagaccggcctccacctgtccttctctgggatgcagccgccggcggtctctgccgccgacccgctctgcagcctcgggctcttcgactggaagtacgaccacatcctctcgggttccggcggctttgagagcgcgaactctgaggctcacttcaccgggccaggcatgatgggcattgccaacggaagcggcggaggcggcgcagagtaccacgcactgaacgcgctccggtacgcagccggccttggagagcacctcgcgcttccgtttggtggcgcgacgtcgcgggctgagcgtgacagtgtcgtcgccgagatgaagccgcaggcggagaggctgctgtcgctggagtggtgcggcgaggcgagccgcgcgccgacggagacctccatcagctccctgggcgggctcggcctgtggagtgccatgatcaccggcgccgcccaccatcaccatggctcctctgccgccatctgaacgaggcgaagcatcgtgtcaacgcccccatgcacgcatgcatgcgttagtggtttgctaatacgcattgacgagtgcgaggactacgtagaagtgattgcctttttcttgcttgctccctgtgtggtttcatgcatgatctgctgctgtttcttttcctttgcttttgttcacatcgtttgtttggatcgatgtttgcaccccttatgtttcaagtgttgtactggacaatgttccgtgttgcacagcttcacacgttgctgtggctcgatcaattaagtttgtgacttgttgctgtcaaaaaaaaaaaaaaaa

SEQ ID NO: 8038 - protein, 294 aa, Triticum aestivum
  misc_feature (1)..(294): Ceres CLONE ID NO.770468
  misc_feature (47)..(109): Pfam Name: zf-Dof Pfam Description: Dof domain, zinc finger
  misc_feature (1)..(294): Functional Homolog of  Ceres ANNOT NO.543998 with e-value of 1.69E-23 and BLAST sequence identity of 85.1
  misc_feature (1)..(294): useful for making plants with altered flowering time as described in USSN 12/281,616
MDSDWLKGIVPEDQGGMGSSSPSGELIIACPEPMQAQQAADRRLRPQHDQPLKCPRCDSTHTKFCYYNNYSLSQPRYFCKTCRRYWTKGGSLRNVPVGGGCRKNKRASAAKKPSAAAAIAPPISMMQQLHHGRHMAETGLHLSFSGMQPPAVSAADPLCSLGLFDWKYDHILSGSGGFESANSEAHFTGPGMMGIANGSGGGGAEYHALNALRYAAGLGEHLALPFGGATSRAERDSVVAEMKPQAERLLSLEWCGEASRAPTETSISSLGGLGLWSAMITGAAHHHHGSSAAI

SEQ ID NO: 8039 - DNA, 1763 bp, Glycine max
  misc_feature (1)..(1763): Ceres CLONE ID no.1361038
  misc_feature (1)..(1763): useful for making plants with altered flowering time as described in USSN 12/281,616
tctcaaatcaacctttgcttttctctttcttttctttgaattttcatggctgtagctgctgtactggccaaaggtggtgtggatttttctcatgtcttttccttgaagcacaatcctgagttatttattctgggttttgggttgttcaaaagctgacacaaaatatcaacttccactagatttaagagttgtttgtatctttgatttaattcttttctagatagctatatatatatatgagaagatcttcatggtaacttcaaggtccacatatattgacattccatcttctctcttttcctaccaaagcaagttttttatcagcaaaagcactgcttttccttttccttccactagctttacctttttgctcgtgtgtgatcatttgttaaagagcacaaaaaattaaaagatactatttgttgttattattatttgattattgattcatttacatttttttaaaaaactttataattgtcttagtgggaagccttgctaccttgctttgatttttgttgttaattaacgatcttcaacaatcttttatgtaaacataaaatcaccaccagctatacctcttgaaattttttgttatggtatagattctaatcattctggggcgatcagtgtggtcgtgtaatacatgtactcacctcacataatgagataaggctttcttgttgatgttgtacagattcttgtcacatatgaaagcttataactataggtgtcctgtctctctctctctctctctctctcttttggggtttctcaggacaatattggacttattgtgagagtagtcatggaggggatggctcccaattcatgtgcaaggccagttctagagaaaaaaacaaggccacaagagcaactgaattgtccaaggtgcaattcaaccaacacaaagttctgttattacaacaactacagcctcacacagccaagatacttctgcaagacttgtagaaggtattggacagaaggagggtctctgagaaacgttccagttggaggtggttcaagaaagaacaagaaggtctctgtgacagcttcatcatcatcatcaccaaaggttccagacctaaacccaccaattaacctctcatcagtctcagctatctcctcacaaaaccctaaaataatgcatggtggccaagatctcaacctggctttcccagctatggaaaagtaccatcatggcatgccaccttatgttgagatgcaaaacagtgacaccaccaccactcatcatcatcaccaaacctcttcttcttgttctgctcctccagcttctctttcagctcttgagctacttaggtcaagcatggcatctaggggtttgaacccttatgctccttcttcttccttgatgccaaactcaacaaacagcaatgccctttactcatcagggtttcccatgcaagaagttaaacctagtcttaacttttcttcagctgatgggatgggaaatagatcatatgatcatcatcagattcaagagaggggtggtggcagacttttgttcccttttggagatgtcaagcagctttctgctgctgcaggtgctgatcaagtggaacacaataaagaacaacaagggaattcaactggttattggactggaatgattggtgaaggaacgtggtaagaaagaaaagaaaaaaagggaggacaaaggaaaattataagagaacatgcattaataacatttatatatatatatatatatatatcttcttttaaaaaaaaaaaaaaaa

SEQ ID NO: 8040 - protein, 281 aa, Glycine max
  misc_feature (1)..(281): Ceres CLONE ID NO.1361038
  misc_feature (19)..(81): Pfam Name: zf-Dof Pfam Description: Dof domain, zinc finger
  misc_feature (1)..(281): Functional Homolog of  Ceres ANNOT NO.543998 with e-value of 8.40E-22 and BLAST sequence identity of 81.1
  misc_feature (1)..(281): useful for making plants with altered flowering time as described in USSN 12/281,616
MEGMAPNSCARPVLEKKTRPQEQLNCPRCNSTNTKFCYYNNYSLTQPRYFCKTCRRYWTEGGSLRNVPVGGGSRKNKKVSVTASSSSSPKVPDLNPPINLSSVSAISSQNPKIMHGGQDLNLAFPAMEKYHHGMPPYVEMQNSDTTTTHHHHQTSSSCSAPPASLSALELLRSSMASRGLNPYAPSSSLMPNSTNSNALYSSGFPMQEVKPSLNFSSADGMGNRSYDHHQIQERGGGRLLFPFGDVKQLSAAAGADQVEHNKEQQGNSTGYWTGMIGEGTW

SEQ ID NO: 8041 - DNA, 572 bp, Glycine max
  misc_feature (1)..(572): Ceres CLONE ID no.1371374
  misc_feature (1)..(572): useful for making plants with altered flowering time as described in USSN 12/281,616
gacaaggtgaactctctctctctctctctctctctttctctctcaaatcaacctttgcttttctctttcttttctttgaattttcatggctgtagctgctgtactggccaaaggtggtgtggatttttctcatgtcttttccttgaagcacaatcctgagttatttattctgggttttgggttgttcaaaagctgacacaaaatatcaacttccactagatttaagagttgtttgtatctttgatttaattcttttctagatagctatatatatatatgagaagatcttcatggtaacttcaaggtccacatatattgacattccatcttctctcttttcctaccaaagcaagttttttatcagcaaaagcactgcttttccttttccttccactagctttacctttttgctcgtgtgtgatcatttgttaaagagcacaaaaaattaaaagatactatttgttgttattattatttgattattgattcatttacatttttttaaaaaactttataattgtcttagtgggaaccttgctactttgctttggatttttgttgttaattaacga

SEQ ID NO: 8042 - protein, 281 aa, Glycine max; identical to SEQ ID NO: 8040
  misc_feature (1)..(281): Ceres CLONE ID NO.1371374
  misc_feature (19)..(81): Pfam Name: zf-Dof Pfam Description: Dof domain, zinc finger
  misc_feature (1)..(281): Functional Homolog of  Ceres ANNOT NO.543998
  misc_feature (1)..(281): useful for making plants with altered flowering time as described in USSN 12/281,616

SEQ ID NO: 8043 - DNA, 852 bp, Arabidopsis thaliana
  misc_feature (1)..(852): Ceres ANNOT ID no.555366
  misc_feature (1)..(852): Ceres LOCUS ID At2g44680
  misc_feature (1)..(852): useful for making plants with altered flowering time as described in USSN 12/281,616
atgtacaaggatcggagtggaggaggaataatgggtggtggtggatcatcgagatcggagatccttggtggagctattgatcggaaacgaatcaatgatgctttagacaaacatcttaagaaatcttcaccttctacatctagggttttcacttctaaggacaaagattctgtcccttctacttcaactgctaaatctcagcttcattctcgttcccccgatgttgaatctgacacggatagtgaaggatcagatgtgagtggttcagaaggtgatgatacctcttggatctcatggttttgtaatttgagagggaatgagtttttctgtgaagtagatgaagattatatacaagatgatttcaatctctgtggtttgagtggtcaagttccttactatgattatgcacttgatctcattttagatgttgaatcatcaaatggtgatatgtttactgaagaacagcatgagatggtggaatcagctgctgagatgttatatggtcttattcatgttcgttatattctcactactaaaggaatggctgctatgatggagaagtataagaattatgatttcgggagatgccccagagttttctgttgcggacagtcttgtcttccggttggccaatctgatatcccgaggtcgagcactgtgaagatatactgcccaaaatgcgaggatatttactacccgcgatctaaataccaaggcaacattgatggagcttactttggaactactttccctcatttgtttctcatggcctatgggaacatgaaaccgcagaagccggctcaaaactacgttcctaagatctttggctttaaggtacacaacaaacaatga

SEQ ID NO: 8044 - protein, 283 aa, Arabidopsis thaliana
  misc_feature (1)..(283): Ceres ANNOT ID NO.555366
  misc_feature (1)..(283): Ceres LOCUS ID At2g44680
  misc_feature (96)..(270): Pfam Name: CK_II_beta Pfam Description: Casein kinase II regulatory subunit
  misc_feature (96)..(270): Pfam Name: CK_II_beta Pfam Description: Casein kinase II regulatory subunit
  misc_feature (1)..(283): Functional Homolog of  Ceres ANNOT NO.555366
  misc_feature (1)..(283): useful for making plants with altered flowering time as described in USSN 12/281,616
MYKDRSGGGIMGGGGSSRSEILGGAIDRKRINDALDKHLKKSSPSTSRVFTSKDKDSVPSTSTAKSQLHSRSPDVESDTDSEGSDVSGSEGDDTSWISWFCNLRGNEFFCEVDEDYIQDDFNLCGLSGQVPYYDYALDLILDVESSNGDMFTEEQHEMVESAAEMLYGLIHVRYILTTKGMAAMMEKYKNYDFGRCPRVFCCGQSCLPVGQSDIPRSSTVKIYCPKCEDIYYPRSKYQGNIDGAYFGTTFPHLFLMAYGNMKPQKPAQNYVPKIFGFKVHNKQ

SEQ ID NO: 8045 - DNA, 903 bp, Populus balsamifera subsp. trichocarpa
  misc_feature (1)..(903): Ceres ANNOT ID no.1496956
  misc_feature (1)..(903): useful for making plants with altered flowering time as described in USSN 12/281,616
atgtacaaagatcgaggcgggtttggtggcgggtcatcaagatcggatattgtaggaggaccgcttgatcgaaagcgtataaatgatgcgctagacaagcatctagagaagtcttctccttcaacttcgagaggattgaataatagtagtaaggataaggagagattatctgttccttctacttctaccggtaaatcattacagcaccatcagcagcagcttgatcatcatcgtgctgattctcgctccgcttcgctttccaaaaacaaatgctctgatgaggaatctgagacagacagtgaggagtcggatgttagtggttctgatggagatgacacatcttggatctcgtggttttgcaatttgcgaggaaatgaatttttctgtgaagttgatgatgagtacattcaggatgattttaatctttgtggactgagcagtcaagttccatactatgattatgcacttgatcttatattggatgttgaatcttctcatggtgatatgttcactgaagaacagaatgagttggtggaatctgcagcagagatgctttacggtcttattcatgtgcgttacatacttactagcaaggggatgtctgccatgttggagaagtacaaaaactatgactttgggagatgcccacgagtttattgctgtggacagccctgcttcccagttggtcaatcagacattcctcgttcaagtactgtcaaaatctactgtccaaaatgtgaagacatctattaccctcgatccaagtatcaagacattgatggagcttattttggaacaacatttcctcacctatttttgatgacatatggtcacctaaagccacagaaggcaacacagagttacgtcccaagagtttttggcttcaaactccacaaaccttga

SEQ ID NO: 8046 - protein, 300 aa, Populus balsamifera subsp. trichocarpa
  misc_feature (1)..(300): Ceres ANNOT ID NO.1496956
  misc_feature (115)..(288): Pfam Name: CK_II_beta Pfam Description: Casein kinase II regulatory subunit
  misc_feature (1)..(300): Functional Homolog of  Ceres ANNOT NO.555366 with e-value of 9.00E-121 and BLAST sequence identity of 85.4
  misc_feature (1)..(300): useful for making plants with altered flowering time as described in USSN 12/281,616
MYKDRGGFGGGSSRSDIVGGPLDRKRINDALDKHLEKSSPSTSRGLNNSSKDKERLSVPSTSTGKSLQHHQQQLDHHRADSRSASLSKNKCSDEESETDSEESDVSGSDGDDTSWISWFCNLRGNEFFCEVDDEYIQDDFNLCGLSSQVPYYDYALDLILDVESSHGDMFTEEQNELVESAAEMLYGLIHVRYILTSKGMSAMLEKYKNYDFGRCPRVYCCGQPCFPVGQSDIPRSSTVKIYCPKCEDIYYPRSKYQDIDGAYFGTTFPHLFLMTYGHLKPQKATQSYVPRVFGFKLHKP

SEQ ID NO: 8047 - DNA, 840 bp, Populus balsamifera subsp. trichocarpa
  misc_feature (1)..(840): Ceres ANNOT ID no.1538806
  misc_feature (1)..(840): useful for making plants with altered flowering time as described in USSN 12/281,616
atgtacagagagcgagggattggtgtgtccaagacggacgtcgatcatcgaaagcagcggattagcgatgtcctcgataagcatctcgaccgatcctctccgtccagttccagacccaccaacggcaaggatttgtttcttttcatgaacaagcagcaaccgcctgatcacaacaacattgaccatctcctctctaaagacaacaacgcctccgttgtggaatctgacacggacagcgaagagtctgatgttagtggttccgatggagatgagacgtcgtggatctcatggttttgcagtctaagagggaatgaattcttttgtgaagttgatgatgattacatacaagatgattttaacctctgtgggttaagcagtcaagttccatactacgattatgcccttgatttgattttggatattgaatcctctcatggtgatatgttcacagaggaacagaatgaattggttgaatctgcagcagagatgctttatggattgattcatgctcgatatatattgaccagcaaagggatgacagctatgctggagaagtacaaaaactatgactttggaagatgccccagagtttgctgctgtggacaaccttgccttccagttggtcaatcagacattcctcggtcaagcactgttaaaatatgctgccccagatgtgatgatatatactacccacgttccaagtatcaagacattgatggagcttattttggaacgacatttcctcacctgtttttaatgactcacgggcatctcaagccgcaaaaggtagtgcagacctatgttcctagagtatttgggttcaagctacacaaaccataa

SEQ ID NO: 8048 - protein, 279 aa, Populus balsamifera subsp. trichocarpa
  misc_feature (1)..(279): Ceres ANNOT ID NO.1538806
  misc_feature (94)..(267): Pfam Name: CK_II_beta Pfam Description: Casein kinase II regulatory subunit
  misc_feature (1)..(279): Functional Homolog of  Ceres ANNOT NO.555366 with e-value of 2.99E-104 and BLAST sequence identity of 76.9
  misc_feature (1)..(279): useful for making plants with altered flowering time as described in USSN 12/281,616
MYRERGIGVSKTDVDHRKQRISDVLDKHLDRSSPSSSRPTNGKDLFLFMNKQQPPDHNNIDHLLSKDNNASVVESDTDSEESDVSGSDGDETSWISWFCSLRGNEFFCEVDDDYIQDDFNLCGLSSQVPYYDYALDLILDIESSHGDMFTEEQNELVESAAEMLYGLIHARYILTSKGMTAMLEKYKNYDFGRCPRVCCCGQPCLPVGQSDIPRSSTVKICCPRCDDIYYPRSKYQDIDGAYFGTTFPHLFLMTHGHLKPQKVVQTYVPRVFGFKLHKP

SEQ ID NO: 8049 - DNA, 900 bp, Populus balsamifera subsp. trichocarpa
  misc_feature (1)..(900): Ceres ANNOT ID no.1539648
  misc_feature (1)..(900): useful for making plants with altered flowering time as described in USSN 12/281,616
atgtacaaagatcgaggtgggtttggtggcgggtcatcaagatcggagattgttggaggacagcttgatcgaaagcgtataaatgatgcgctagacaagcatctagagaagtcttctccttcaacttcgagaggattgaataatagtagtaaggataaagaaagattgtctgttccttctacttccactggtaaatcatcacagcatcagcagcatcttgaacatcatcgtgctgattcccgctctgcttcgctatccaaaaacaaatgctctgatgaggaatctgagacagacagtgaggagtctgatgttagtggttctgatggagatgatacatcttggatctcatggttttgcaatttgcgtggaaatgaatttttctgtgaagttgatgacgagtacattcaggatgattttaatctttgtggattgagcagtcaagttccatactatgattatgcacttgatcttatattggatgttgaatcttctcatggtgatatgttcaccgaagaacagaatgagttggtggaatccgcagcagagatgctctacggtcttattcatgtgcgttacatacttactagcaaggggatgtctgcaatgttggaaaagtacaaaaactatgactttgggagatgcccacgagtttattgctgtggacagccctgccttccggttggtcaatcagacattcctcgttctagtactgtcaaaatctactgtccaaaatgtgaagacatctattaccctcgatccaagtatcaagacattgatggagcttattttggaaccacattccctcacctatttttgatgacatatggacacctaaagccacagaaagcaatacagagctacgttccaagagtttttggcttcaaactccacaagccttga

SEQ ID NO: 8050 - protein, 299 aa, Populus balsamifera subsp. trichocarpa
  misc_feature (1)..(299): Ceres ANNOT ID NO.1539648
  misc_feature (114)..(287): Pfam Name: CK_II_beta Pfam Description: Casein kinase II regulatory subunit
  misc_feature (1)..(299): Functional Homolog of  Ceres ANNOT NO.555366 with e-value of 7.80E-122 and BLAST sequence identity of 86.1
  misc_feature (1)..(299): useful for making plants with altered flowering time as described in USSN 12/281,616
MYKDRGGFGGGSSRSEIVGGQLDRKRINDALDKHLEKSSPSTSRGLNNSSKDKERLSVPSTSTGKSSQHQQHLEHHRADSRSASLSKNKCSDEESETDSEESDVSGSDGDDTSWISWFCNLRGNEFFCEVDDEYIQDDFNLCGLSSQVPYYDYALDLILDVESSHGDMFTEEQNELVESAAEMLYGLIHVRYILTSKGMSAMLEKYKNYDFGRCPRVYCCGQPCLPVGQSDIPRSSTVKIYCPKCEDIYYPRSKYQDIDGAYFGTTFPHLFLMTYGHLKPQKAIQSYVPRVFGFKLHKP

SEQ ID NO: 8051 - DNA, 1256 bp, Zea mays subsp. mays
  misc_feature (1)..(1256): Ceres CLONE ID no.275781
  misc_feature (1)..(1256): useful for making plants with altered flowering time as described in USSN 12/281,616
gtgctccccccaggctcctcttcctcgctttccctccaccccgggcgcaaaccctaaccctaccgtcgctcgccccgcggcgtctgccaatggcgcgccccgtgtgagtgtgcgcgagagaggggtagaccttgaggccgctacccggggaggagagcgagagatgtataaacaggggggagcggggggaggggctgggctggaccggaagcggatcaacgacgcgctggataagcatgctcgagaaggcggtcgcgtcgccgtccacgtcgagggggtcggcgggcggcgggcgcgaccaccaccgcctcgtcgtgccgtcctccgtgtcgtccatccccaagggccgctgctccgaaggggagtctgattctgatagtgaagcatcggatgttagcggctctgatggagaagacacctcatggatttcatggtattgcaacttaagagggaatgagttcttctgtgaagtcgacgatgattatattcaagacgactttcaacctttgtggtctcagcagccaaagttccttattatgattatgctctcgatctcattttagatatcgagtcatctcatggtgatatgttcacttgaggaacaaaatgagctcgtagaatcagctgcagagatgctttatggtctgatacatgcacgatacattctgaccagtaaaggactggctgcaatgctggagaagtataagaactatgactttgggcggtgcccgcgtgtttactgctgtggtcaaccatgcctgccagttggacaatcagacatccatcgatctagtaccgtgaagatatrctgccccaagkgtgaagacatctactacccacggtccaagtaccaaggcaacatcgacggcgcatactttgggacaacgttccctcatctgttcctgatgacatacgagcacctcaagccacagaagctctcgcagcgctatgttcctcgtgtctttggcttcaagctccacaagccatgaacctcatgtatttgtcttttaaactcctcaagacgtggcactgggggcatgcgggagttttgcaatccttgaagacttgcatataagagcgccattggcaggtcagtggattggtaaaattctatcatgctgcagcgtgcttgtaccttagctggctggcacctatccaacatttgaatgtagctctmaggatatcaatgttgtaacctaactgctattgttctttgattagtaaaccaggagccccccctacaatgtagaatatgg

SEQ ID NO: 8052 - protein, 273 aa, Zea mays subsp. mays
  misc_feature (1)..(273): Ceres CLONE ID NO.275781
  misc_feature (1)..(273): Functional Homolog of  Ceres ANNOT NO.555366
  misc_feature (1)..(273): useful for making plants with altered flowering time as described in USSN 12/281,616
MYKQGGAGGGAGLDRKRINDALDKHLEKAVASPSTSRGSAGGGRDHHRLVVPSSVSSIPKGRCSEGESDSDSEASDVSGSDGEDTSWISWYCNLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYEHLKPQKLSQRYVPRVFGFKLHKP

SEQ ID NO: 8053 - DNA, 1386 bp, Zea mays
  misc_feature (1)..(1386): Ceres CLONE ID no.281518
  misc_feature (1)..(1386): useful for making plants with altered flowering time as described in USSN 12/281,616
tgtttcctatcctttttcattcccacccgcccatcccttcaaaattcgctgcgtgtccctctctctccctgcgctcgtgctccgcccaggcccctttcctccaccgcgggcgcaaaccctaaccctacagccgctcgccccgcggcgcctgccaatggcgccccccgtgtgagtgtgtgtgagaggcagagacctagaggccgctacccggggaggagagggagggagagggagaggctgatagatgtataagcaggggggagcgggggtaggggctggtctggaccggaaacggatcagcgacgcgctagacaagcaccttgagaaggcggtcgcatcgccgtccacatcgagggggtcarcgggcggcggcggtgtgcgcgaccaccaccgcctcatcgtgccgtcctccgtgtcgtccatccccaagggccgctgctccgaaggggagtctgattctgatagtgaagcatcagatgttagtggctctgatggagaagacacctcgtggatttcatggtattgcaacttaagagggaatgagttcttctgtgaagtcgatgatgactacattcaagacgacttcaacctttgtggcctcagcagccaagttccttattatgattatgctcttgatctcattttagatattgaatcatctcatggtgatatgttcactgaggaacaaaatgagctcgtagaatcagctgcagagatgctttatgggctgatccatgcacgatacattctgaccagtaaagggctggctgcaatgctggagaagtataggaactatgacttcgggcggtgcccgcgtgtttactgctgtggtcaaccatgcctgccggttggacaatcagatattcatcgatgctagtaccgtgaaaatatactgccccaagtgtgaagacatctactacccacggtccaagtaccaaggcaacatcgacggcgcatattttgggacaacgttccctcacctgttcctgatgacatacgagcacctcaagctacagaascccttgcagcgcthtgttcctcgtgtctttggcttcaagctccataagccatgagcctcatgtatttggcttcaagctccataacccagagttttgcgagatcaaggtccttgaagactacatataagagcgccattggctacatataaaagcgctattgacagatcagtggattgataaaactccaccatgcagcggagcgcttttaccttacctggctggcacctaccaacatttgaatgtagctctaaggataccgatgttgttgtaacctaactgtaattgtttttttgattagtaaaccaggaccccgtacgatgtagagtatgggcattatttatggcttatgcaaaaaaaatcgttatgc

SEQ ID NO: 8054 - protein, 275 aa, Zea mays
  misc_feature (1)..(275): Ceres CLONE ID NO.281518
  misc_feature (89)..(263): Pfam Name: CK_II_beta Pfam Description: Casein kinase II regulatory subunit
  misc_feature (89)..(263): Pfam Name: CK_II_beta Pfam Description: Casein kinase II regulatory subunit
  misc_feature (1)..(275): Functional Homolog of  Ceres ANNOT NO.555366 with e-value of 8.49E-109 and BLAST sequence identity of 77.2
  misc_feature (1)..(275): useful for making plants with altered flowering time as described in USSN 12/281,616
MYKQGGAGVGAGLDRKRISDALDKHLEKAVASPSTSRGSAGGGGVRDHHRLIVPSSVSSIPKGRCSEGESDSDSEASDVSGSDGEDTSWISWYCNLRGNEFFCEVDDDYIQDDFNLCGLSSQVPYYDYALDLILDIESSHGDMFTEEQNELVESAAEMLYGLIHARYILTSKGLAAMLEKYRNYDFGRCPRVYCCGQPCLPVGQSDIHRSSTVKIYCPKCEDIYYPRSKYQGNIDGAYFGTTFPHLFLMTYEHLKLQKPLQRYVPRVFGFKLHKP

SEQ ID NO: 8055 - DNA, 1320 bp, Glycine max
  misc_feature (1)..(1320): Ceres CLONE ID no.471202
  misc_feature (1)..(1320): useful for making plants with altered flowering time as described in USSN 12/281,616
gcgaggaatagaaacgaaccgaaacggggaatcattgtctgcgtctgtaaattgtaaattgcatcatccctgaagctgaacctcaaaaccctagctgccggcttgtctgcaacggcatcgtttcagtatctcgttatgattagttgagaatccaaaggaatcgaatcgaatcatctcgacgagaagcaaaacaccggctatagttatgtacagagagcgaggaggcgtcggatccaaatcggaggtaacttccgttgatcggaagcgaatcaatgacgtcctcgataaacagctcgaacgatcctcgccgtccacatccagagccgccggcgccatcaacggcaaggaccgctcctcctcttccctcttagccgccgccaaggactcccgctccgcctccgtcaccgcccctatctccaagaattccaacgcttccgacgaggaatctgaaacagacagcgaggagtctgatgttagtggctccgacggagatgacacgtcgtggatctcgtggttctgcaatttgagaggaaatgaattcttctgcgaggttgatgacgattacatccaggacgacttcaacctctgtggattgagcagtcaagtgccttactatgattatgctctggatttgattttggatgttgaatcctctcatggtgacatgtttaccgaggaacagaatgagttaattgaatcagcagccgagatgctttatggtctgattcatgcccggtacatattgacaagcaaaggaatggctgcaatgctcgacaagtacaagaactatgattttggcagatgcccacgagtttactgctctggacaaccttgtattccagttggtcagtcagacatccctaggtctagtactgtgaaaatatactgccctcggtgtgaagacatttactatcctcggtccaagtatcaaggcaacattgatggagcttattttggaactacgtttcctcatctgttcttgatgacttatggacaactaaagccacagaaaccatcacagagctatgtcccgagagtttttggcttcaaacttcacaagccctgaagctgaaattttaagcttccatgaaagagcatgttgtaaagagaattgcagacgcgacatgtcatgcaagtgcttagtttcaatttcagcttggaattcagtgagcttcaagttcaatgagcaagtgcgtaatacttcaatgcactctaagtgcttattgcaaattgtattcttgcggttagttttaattaaagttgtttatgtttgtctcagattacagatactctactattttatattattttattccattt

SEQ ID NO: 8056 - protein, 286 aa, Glycine max
  misc_feature (1)..(286): Ceres CLONE ID NO.471202
  misc_feature (1)..(286): Functional Homolog of  Ceres ANNOT NO.555366 with e-value of 8.80E-114 and BLAST sequence identity of 79.3
  misc_feature (1)..(286): useful for making plants with altered flowering time as described in USSN 12/281,616
MYRERGGVGSKSEVTSVDRKRINDVLDKQLERSSPSTSRAAGAINGKDRSSSSLLAAAKDSRSASVTAPISKNSNASDEESETDSEESDVSGSDGDDTSWISWFCNLRGNEFFCEVDDDYIQDDFNLCGLSSQVPYYDYALDLILDVESSHGDMFTEEQNELIESAAEMLYGLIHARYILTSKGMAAMLDKYKNYDFGRCPRVYCSGQPCIPVGQSDIPRSSTVKIYCPRCEDIYYPRSKYQGNIDGAYFGTTFPHLFLMTYGQLKPQKPSQSYVPRVFGFKLHKP

SEQ ID NO: 8057 - DNA, 1306 bp, Glycine max
  misc_feature (1)..(1306): Ceres CLONE ID no.542752
  misc_feature (1)..(1306): useful for making plants with altered flowering time as described in USSN 12/281,616
aaaagttggcacctggcagcaagtagtagtaacaatttaggattgtggtgtgttgttgttgttgtagctatcagtaggtgaatccaaaaccctagccctcactctcaccaccattttttcaattcttgagctatgtttcagggataatagggcagggatgtacaaagaacgagagcgaggtggtgtttccgtttccgcctctaaatccgaggatcggaagcgaatcaacgacgttctcgataagcacttggaacgatcctctccttccacttcccgccccatcaacaccgcttccaagaattccaacctccaagtggaggaatctgagacggagagtgaagagtctgatgttagtggctctgatggggatgacacctcttggatctcgtggttctgtaatctaagagggaatgagttcttttgtgaggtggatgatgattacatacaggatgactttaacctctgtggattgagcagtcaagtgccctactttgattatgcccttgatttgattctcgacgttgagtcatcccatggtgacatgttcacggaggaacagaatgagttgattgaatcggcggcggaaatgctttatggtatgattcatgctcgatatgtgttgaccagcaaaggaatggctgccatgcttgacaaatacaagagctatgattttggtagatgcccaagagtttactgctctggacagccctgccttccagttggtcaatcggacattcctaggtcaagtactgtgaaaatatactgccctaggtgtgaagatctttactatccgcgttccaagtatcaaggcaacattgatggagcttactttggaacaacatttccacacctcttcttgatgacttatggacaactgaagccacagaaaccagcacaaggctatgttccgagagtttttgggttcaaagttcacaagccataaagccgaagttgaagctttcatgaaagtaaaaatctccccgtgtctcatttaactcttcttatggttctctttgcaacaacaggcgaatcatatgctttccaaaccagtacaatctaggcatctgttttacttgttataggagcttgttgtaaagaaatatgcagacatgtgaagcaagtgcttagtttcagcttctgattcaatgagcaagtgcttaggtactcgatggtacttcttaatggctttttacaaattgtattcttgcaattaacttaatattgtctatggttatgtctcgaattacaaataccctgctatttttatattgttttattccatttcaagaaaaaaaaaaaaaaaaaa

SEQ ID NO: 8058 - protein, 261 aa, Glycine max
  misc_feature (1)..(261): Ceres CLONE ID NO.542752
  misc_feature (1)..(261): Functional Homolog of  Ceres ANNOT NO.555366 with e-value of 3.90E-111 and BLAST sequence identity of 79.9
  misc_feature (1)..(261): useful for making plants with altered flowering time as described in USSN 12/281,616
MYKERERGGVSVSASKSEDRKRINDVLDKHLERSSPSTSRPINTASKNSNLQVEESETESEESDVSGSDGDDTSWISWFCNLRGNEFFCEVDDDYIQDDFNLCGLSSQVPYFDYALDLILDVESSHGDMFTEEQNELIESAAEMLYGMIHARYVLTSKGMAAMLDKYKSYDFGRCPRVYCSGQPCLPVGQSDIPRSSTVKIYCPRCEDLYYPRSKYQGNIDGAYFGTTFPHLFLMTYGQLKPQKPAQGYVPRVFGFKVHKP

SEQ ID NO: 8059 - DNA, 1533 bp, Triticum aestivum
  misc_feature (1)..(1533): Ceres CLONE ID no.570159
  misc_feature (1)..(1533): useful for making plants with altered flowering time as described in USSN 12/281,616
atggcatgcgctatatcttcctccccaaagtttgtcggaattacaaaacagcccccgtactcttcctccccacctctcgcctaccgttcgcgtcctccgcccgaggcctccacgggagcgccggagcgcacgcctgatctccccgcctcctcctcccggcaccgcggccccggctcctagcccgcctcacgatcgggggacgaggcacgagtaggagggcgagggtgcgaggagatgcagagggaccgaggcgtctcggcggccgctgggggcgccggtgagaggaagcggataggcgaggcgatggacaggtcctccccgtcgacgtcctgggggttctccggcggacgcgagagggaccggatcgccgccggcaagcagccggaggtgccccgctccggcggcggatccaccgccatgtccaagggcaagttgtccgatggagaatcggatactgacagtgaagaatcagatctcagtggttctgatggagaagatacatcgtggatttcatggttctgtagcttgcgaggcaatgagtttttctgtgaagttgatgacgattacatacaagacgatttcaatctctgtgggctaagcggtcaagttccatattatgaatatgctcttgatctgatattggatgtcgagtcttcacatggtgatatgttcacagaagagcagaatgaacttattgaatcagctgctgagatgctttatggattgattcatgttcgatatattcttacaagtaaaggattggctgcaatgttggataaatacaagaattatgactttggcagatgtccaagagtgcactgcagcggccagccatgccttccagttggccagtcggacattcctcgttctagtaatgtgaaaatttactgcccaaagtgtgaagatctctactatccgagatccaaatatcaaagcaacattgacggagcttactttgggacaacgtttcctcacttgtttctgatgacgtacccacatttgaagccccagaaaccgtcacagcagtacgtccccaaggtttttggcttcaaacttcataagccataacaagtttgaagactgaaggtgcaaaaggttcatagcagagttgtctgatatgtcacgctgcacatcacttccaagctgctcatttgtgcgcgtggcgcagtttagcacttggttcagttggttacccgtggcttggccgaaaccgacctgacctctggctgatttcccttgtcctccgttttcgctctcgcctgacgttctgatttgatccttgtggcttgtttagtgtagtagatttcttctatcctgttctttatactcattattatatttgagtttggcagttgctaaaagaaggcagttcgtaacagtgttatgtctctgctgtgtatttttcattttgttttacattaggttcctttgccaaaatgtgatggtaatggtaatctgaaacattcgatccggctattcttattcttcacctgcaactgagtttgtatggaaagtttaaaaaaaaaaaaaaaa

SEQ ID NO: 8060 - protein, 277 aa, Triticum aestivum
  misc_feature (1)..(277): Ceres CLONE ID NO.570159
  misc_feature (1)..(277): Functional Homolog of  Ceres ANNOT NO.555366 with e-value of 1.60E-105 and BLAST sequence identity of 78.5
  misc_feature (1)..(277): useful for making plants with altered flowering time as described in USSN 12/281,616
MQRDRGVSAAAGGAGERKRIGEAMDRSSPSTSWGFSGGRERDRIAAGKQPEVPRSGGGSTAMSKGKLSDGESDTDSEESDLSGSDGEDTSWISWFCSLRGNEFFCEVDDDYIQDDFNLCGLSGQVPYYEYALDLILDVESSHGDMFTEEQNELIESAAEMLYGLIHVRYILTSKGLAAMLDKYKNYDFGRCPRVHCSGQPCLPVGQSDIPRSSNVKIYCPKCEDLYYPRSKYQSNIDGAYFGTTFPHLFLMTYPHLKPQKPSQQYVPKVFGFKLHKP

SEQ ID NO: 8061 - DNA, 1151 bp, Glycine max
  misc_feature (1)..(1151): Ceres CLONE ID no.643751
  misc_feature (1)..(1151): useful for making plants with altered flowering time as described in USSN 12/281,616
aacaatttaggattgtggtgtgttgttgttgttgtagctatcagtagggataatagggcagggatgtacaaagaacgagagcgaggtggtgtttccgtttccgcctctaaatccgaggatcggaagcgaatcaacgacgttctcgataagcacttggaacgatcctctccttccacttcccgccccatcaacaccgcttccaagaattccaacctccaagtggaggaatctgagacggagagtgaagagtctgatgttagtggctctgatggggatgacacctcttggatctcgtggttctgtaatctaagagggaatgagttcttttgtgaggtggatgatgattacatacaggatgactttaacctctgtggattgagcagtcaagtgccctactttgattatgcccttgatttgattctcgacgttgagtcatcccatggtgacatgttcacggaggaacagaatgagttgattgaatcggcggcggaaatgctttatggtatgattcatgctcgatatgtgttgaccagcaaaggaatggctgccatgcttgacaaatacaagagctatgattttggtagatgcccaagagtttactgctctggacagccctgccttccagttggtcaatcggacattcctaggtcaagtactgtgaaaatatactgccctaggtgtgaagatctttactatccgcgttccaagtatcaaggcaacattgatggagcttactttggaacaacatttccacacctcttcttgatgacttatggacaactgaagccacagaaaccagcacaaggctatgttccgagagtttttgggttcaaagttcacaagccataaagccgaagttgaagctttcatgaaagtaaaaatctccccgtgtctcatttaactcttcttatggttctctttgcaacaacaggcgaatcatatgctttccaaaccagtacaatctaggcatctgttttacttgttataggagcttgttgtaaagaaatatgcagacatgtgaagcaagtgcttagtttcagcttctgattcaatgagcaagtgcttaggtactcgatggtacttcttaatggctttttacaaattgtattcttgcaattaacttaatattgtctatggttatgtctcgaatt

SEQ ID NO: 8062 - protein, 282 aa, Glycine max
  misc_feature (1)..(282): Ceres CLONE ID NO.643751
  misc_feature (1)..(282): Functional Homolog of  Ceres ANNOT NO.555366 with e-value of 3.90E-111 and BLAST sequence identity of 79.9
  misc_feature (1)..(282): useful for making plants with altered flowering time as described in USSN 12/281,616
NNLGLWCVVVVVAISRDNRAGMYKERERGGVSVSASKSEDRKRINDVLDKHLERSSPSTSRPINTASKNSNLQVEESETESEESDVSGSDGDDTSWISWFCNLRGNEFFCEVDDDYIQDDFNLCGLSSQVPYFDYALDLILDVESSHGDMFTEEQNELIESAAEMLYGMIHARYVLTSKGMAAMLDKYKSYDFGRCPRVYCSGQPCLPVGQSDIPRSSTVKIYCPRCEDLYYPRSKYQGNIDGAYFGTTFPHLFLMTYGQLKPQKPAQGYVPRVFGFKVHKP

SEQ ID NO: 8063 - DNA, 1173 bp, Glycine max
  misc_feature (1)..(1173): Ceres CLONE ID no.1023028
  misc_feature (1)..(1173): useful for making plants with altered flowering time as described in USSN 12/281,616
ctctccatctcgttcctcccccacctgcgcagccaagaagttcaaaccctagtccagcctgcgagcgccgacacgtcgcgccgtgcggcttcccgcaagcaggggctcgggccgaccgcgggggatgagcggcgcagcctacagggaccggggattcggcggcgccgcggagatggaccggaagcgcatcaaggaggcgctcgagaagcacacggagaggccgtccccgtccacctccaggggggcgtccagggagaaggagctgctcgccgccggcaagataaccactcagatcggcaaggtccccaaggtctccgacgtcgaggaattcgaaactgacagtgaagattctgatgttagtggttctgaaggagaggacacatcttggatttcatggttctgtagcttgcgaggcaacgaattcttctgtgagattgatgatgattatatacaggatgatttcaatctctgtggcctaagcagtcaggtgccatattatgattatgcacttgatctcatcctagacattgagtcttctaatggtgatgtattcactgaggagcaaaatgaattaattgagtcatctgcagagatgctgtatggtttaattcatgcacgttacatcttaaccagcaagggtctagctgcaatgttagagaagttcaagaactatgattttggcagatgccctcgagtatactgctgtggtcaaccctgtcttccagcaggacaatcagacattcctaggtcaagcacagtgaaggtgttttgtccaaaatgtgaagatttacactatccaaggtccaagtaccaaggcaacattgatggagcatactttggtacgacattccctcatctcttcttgatgacatacccacacctgaagccacagaagccatcacagcaatatgttccaagagtttttggcttcaaacttcacaagcaatcatgacgaacttttaccagtgagcgctatttgtttttacctagtgttagagatggaacaccttggcctgaaaatgttgtggcctcttgattcgagtactcgcgagctcgaatcttgctgtaaactgctgagcaactgtatctgttttgttgtatgactgttgtgtaatctaggtttcctcacttgatcaatctatgcacatttgcatgttaaaaaaaaaaaaaaaa

SEQ ID NO: 8064 - protein, 259 aa, Glycine max
  misc_feature (1)..(259): Ceres CLONE ID NO.1023028
  misc_feature (72)..(246): Pfam Name: CK_II_beta Pfam Description: Casein kinase II regulatory subunit
  misc_feature (1)..(259): Functional Homolog of  Ceres ANNOT NO.555366 with e-value of 4.19E-107 and BLAST sequence identity of 74.2
  misc_feature (1)..(259): useful for making plants with altered flowering time as described in USSN 12/281,616
MDRKRIKEALEKHTERPSPSTSRGASREKELLAAGKITTQIGKVPKVSDVEEFETDSEDSDVSGSEGEDTSWISWFCSLRGNEFFCEIDDDYIQDDFNLCGLSSQVPYYDYALDLILDIESSNGDVFTEEQNELIESSAEMLYGLIHARYILTSKGLAAMLEKFKNYDFGRCPRVYCCGQPCLPAGQSDIPRSSTVKVFCPKCEDLHYPRSKYQGNIDGAYFGTTFPHLFLMTYPHLKPQKPSQQYVPRVFGFKLHKQS

SEQ ID NO: 8065 - DNA, 1164 bp, Triticum aestivum
  misc_feature (1)..(1164): Ceres CLONE ID no.1032174
  misc_feature (1)..(1164): useful for making plants with altered flowering time as described in USSN 12/281,616
ctctctcctctccatctcgttcctcccccacctgcgcagccaagaagttcaaaccctagtccagcctgcgagcgccgacacgtcgcgccgtgcggcttcccgcaagcaggggctcgggccgaccgcgggggatgagcggcgcagcctacagggaccggggattcggcggcgccgcggagatggaccggaagcgcatcaaggaggcgctcgagaagcacacggagaggccgtccccgtccacctccaggggggcgtccagggagaaggagctgctcgccgccggcaagataaccactcagatcggcaaggtccccaaggtctccgacgtcgaggaattcgaaactgacagtgaagattctgatgttagtggttctgaaggagaggacacatcttggatttcatggttctgtagcttgcgaggcaacgaattcttctgtgagattgatgatgattatatacaggatgatttcaatctctgtggcctaagcagtcaggtgccatattatgattatgcacttgatctcatcctagacattgagtcttctaatggtgatgtattcactgaggagcaaaatgaattaattgagtcatctgcagagatgctgtatggtttaattcatgcacgttacatcttaaccagcaagggtctagctgcaatgttagagaagtycaagaactatgattttggcagatgccctcgagtatactgctgtggtcaaccctgtcttccagcaggacaatcagacattcctaggtcaagcacagtgaaggtgttttgtccaaaatgtgaagatttacactatccaaggtccaagtaccaaggcaatattgatggagcatactttggtacgacattccctcatctcttcttgatgacatacccacacctgaagccacagaagccatcacagcaatatgttccaagagtttttggcttcaaacttcacaagcaatcatgacgaacttttaccagtgagcgctatttgtttttacctagtgttagagatggaacaccttggcctgaaaatgttgtggcctcttgattcgagtactcgcgagctcgaatcttgctgtaaactgctgagcaactgtatctgttttgttgtatgactgttgtgtaatctaggtttcctcacttgatcaatctatgcacatttgcatgtc

SEQ ID NO: 8066 - protein, 275 aa, Triticum aestivum
  misc_feature (1)..(275): Ceres CLONE ID NO.1032174
  misc_feature (88)..(262): Pfam Name: CK_II_beta Pfam Description: Casein kinase II regulatory subunit
  misc_feature (1)..(275): Functional Homolog of  Ceres ANNOT NO.555366 with e-value of 2.89E-108 and BLAST sequence identity of 72.7
  misc_feature (180)..(180): Xaa is any aa, unknown, or other
  misc_feature (1)..(275): useful for making plants with altered flowering time as described in USSN 12/281,616
MSGAAYRDRGFGGAAEMDRKRIKEALEKHTERPSPSTSRGASREKELLAAGKITTQIGKVPKVSDVEEFETDSEDSDVSGSEGEDTSWISWFCSLRGNEFFCEIDDDYIQDDFNLCGLSSQVPYYDYALDLILDIESSNGDVFTEEQNELIESSAEMLYGLIHARYILTSKGLAAMLEKXKNYDFGRCPRVYCCGQPCLPAGQSDIPRSSTVKVFCPKCEDLHYPRSKYQGNIDGAYFGTTFPHLFLMTYPHLKPQKPSQQYVPRVFGFKLHKQS

SEQ ID NO: 8067 - DNA, 864 bp, Populus balsamifera subsp. trichocarpa
  misc_feature (1)..(864): Ceres ANNOT ID no.1486236
  misc_feature (1)..(864): useful for making plants with altered flowering time as described in USSN 12/281,616
atgtacaaagatcgaggtgggtttggtggcgggtcatcaagatcggagattgttggaggacagcttgatcgaaagcgtataaatgatgcgctagacaagcatctagagaagtcttctccttcaacttcgagaggattgaataatagtagtaaggataaagaaagattgtctgttccttctacttccactggtaaatcatcacagcatcagcagcatcttgaacatcatcgtgctgattcccgctctgcttcgctatccaaaaacaaatgctctgatgcttgtttggtggtatgggatcttgaggaatctgagacagacagtgaggagtctgatgttagtggttctgatggagatgatacatcttggatctcatggttttgcaatttgcgtggaaatgaatttttctgtgaagttgatgacgagtacattcaggatgattttaatctttgtggattgagcagtcaagttccatactatgattatgcacttgatcttatattggatgttgaatcttctcatggcttcacaaagttccagactggaccgcttcttctatgcatttgcacattctcaggtgatatgttcaccgaagaacagaatgagttggtggaatccgcagcagagatgctctacggtcttattcatgtgcgttacatacttactagcaaggggatgtctgcaatgttggaaaagtacaaaaactatgactttgggagatgcccacgagtttattgctgtggacagccctgccttccggttggtcaatcagacattcctcgttctagtactgtcaaaatctactgtccaaaatgtgaagacatctattaccctcgatccaagtatcaaggcagtatccttccatga

SEQ ID NO: 8068 - protein, 287 aa, Populus balsamifera subsp. trichocarpa
  misc_feature (1)..(287): Ceres ANNOT ID NO.1486236
  misc_feature (122)..(287): Pfam Name: CK_II_beta Pfam Description: Casein kinase II regulatory subunit
  misc_feature (1)..(287): Functional Homolog of  Ceres ANNOT NO.555366 with e-value of 1.40E-97 and BLAST sequence identity of 87.3
  misc_feature (1)..(287): useful for making plants with altered flowering time as described in USSN 12/281,616
MYKDRGGFGGGSSRSEIVGGQLDRKRINDALDKHLEKSSPSTSRGLNNSSKDKERLSVPSTSTGKSSQHQQHLEHHRADSRSASLSKNKCSDACLVVWDLEESETDSEESDVSGSDGDDTSWISWFCNLRGNEFFCEVDDEYIQDDFNLCGLSSQVPYYDYALDLILDVESSHGFTKFQTGPLLLCICTFSGDMFTEEQNELVESAAEMLYGLIHVRYILTSKGMSAMLEKYKNYDFGRCPRVYCCGQPCLPVGQSDIPRSSTVKIYCPKCEDIYYPRSKYQGSILP

SEQ ID NO: 8069 - DNA, 1231 bp, Zea mays
  misc_feature (1)..(1231): Ceres CLONE ID no.1486490
  misc_feature (1)..(1231): useful for making plants with altered flowering time as described in USSN 12/281,616
cagccgcccacctcacgcaagcggcaagcccacgggcgctctctctccccctgcgcctcgtcgcctctccaatccctctcgtcctctcgctttctctctccatctcgtttcccccgcctgcgcagccagcgcaaaccctagccaacaagcgccgttctgcgaggctctcggcagcggataacttaacctgtcgcgcaaggatcgggggagagaaaccagcggcaacttacgtggatcggggttgtttggtgctgctgcggcggcgcagggatggaccggaagcgcatcaaggacgcgctcgagaagcacctggagaggtcgtcgccgtctacttccaggggcgtcgtgtccaaggagagggagcgcctcgctgccgggaagctgccgtcatcgcttggcaaggcggaggtgtctgatggtgaggaatttgaaactgacagtgaagattctgatgtgagtggttccgagggagaggacacgtcctggatttcatggttctgtacattgcgaggcaatgaattcttttgtgagatcgatgatgactatatacaggatgattttaacctgtgtggtctgagtaatcaggtgccatattatgattatgcacttgatctcatcttagacattgagtcttctaatgatgacgggtttaccgaggagcaaaatgaattaatcgagtcatctgcagagatgctgtacggtttaattcatgcacgatacattttaaccagcaagggtctagctgcaatgttggagaagttcaagaactacgactttggtagatgccccagggtgtactgctgtggccagccctgccttccagcagggcaatcagatgttcctagatcgagcactgtgaagatatattgtccgaaatgcgaagaacttaactatccaagatccaagtaccaaggcaacatcgatggatcatactttgggacgacattccctcatcttttcctgatgacttactcgcacttgaagccgcagaagccgtcacagcaatacactccaagggttttcggcttcaaacttcacaagccgtcatgacagagttgtagcttccgccagaagcacccctgtcacctaggttttagggagagcatcgtggccttcaaatactgttgtattattgatgtacgaattcgcgagcctgggcctcgctgtaaactattgtgaaattgtatcttttttccgatattattactgttgtgcaaaaaaaaaaaaaaaa

SEQ ID NO: 8070 - protein, 259 aa, Zea mays
  misc_feature (1)..(259): Ceres CLONE ID NO.1486490
  misc_feature (1)..(259): Functional Homolog of  Ceres ANNOT NO.555366 with e-value of 3.30E-107 and BLAST sequence identity of 74.1
  misc_feature (1)..(259): useful for making plants with altered flowering time as described in USSN 12/281,616
MDRKRIKDALEKHLERSSPSTSRGVVSKERERLAAGKLPSSLGKAEVSDGEEFETDSEDSDVSGSEGEDTSWISWFCTLRGNEFFCEIDDDYIQDDFNLCGLSNQVPYYDYALDLILDIESSNDDGFTEEQNELIESSAEMLYGLIHARYILTSKGLAAMLEKFKNYDFGRCPRVYCCGQPCLPAGQSDVPRSSTVKIYCPKCEELNYPRSKYQGNIDGSYFGTTFPHLFLMTYSHLKPQKPSQQYTPRVFGFKLHKPS

SEQ ID NO: 8071 - DNA, 717 bp, Gossypium hirsutum
  misc_feature (1)..(717): Ceres CLONE ID no.1914315
  misc_feature (1)..(717): useful for making plants with altered flowering time as described in USSN 12/281,616
atttttaccccaatttgtctcctttccctcttcttcatccccaccttcttcaacctccgacttttttttctttatattctcaaataaaaaccgttttttgcttcatccccaccctgcgaaaaccctttaatttctcaattccagggctttttcttcatgttactctcccctcacggcgccatgaatccaaaaaagcttgattttttgcccctgcattgaaaaaagttgggagcttttgcgaatttgcgttgtgaaaggtaaaaaaaaaaaaaagttatgtatagtcatagagatcgaggaggaggaaggggaggaccgttggatcggaagcgcataaacgatgcgctggacaagtcttccccgtccacttcgaggggcttcaacagcaaagacaaaggaagaccctctgttccttcaacttccgctggtaaatccctgctttctcatcgcgattcacgttccaaagccaaatgttctgctgaggagtcagaaaccgacagtgaagaatcagacgttagtggttccgagggagatgacacgtcttggatttcatggttttgcggtttgcgaggcaatgagttcttttgtgaagttgatgatgaatacatccaagatgacttcaatctttgcgggttgagcagtcaagttccatattatgactacgcccttgatttaatattggatgttgaatcttctcatggtgatatgttcaccgaa

SEQ ID NO: 8072 - protein, 276 aa, Gossypium hirsutum
  misc_feature (1)..(276): Ceres CLONE ID NO.1914315
  misc_feature (1)..(276): Functional Homolog of  Ceres ANNOT NO.555366 with e-value of 2.00E-114 and BLAST sequence identity of 85.0
  misc_feature (1)..(276): useful for making plants with altered flowering time as described in USSN 12/281,616
MYSHRDRGGGRGGPLDRKRINDALDKSSPSTSRGFNSKDKGRPSVPSTSAGKSLLSHRDSRSKAKCSAEESETDSEESDVSGSEGDDTSWISWFCGLRGNEFFCEVDDEYIQDDFNLCGLSSQVPYYDYALDLILDVESSHGDMFTEEQNELVESAAEMLYGLIHVRYILTSKGMSAMLEKYKSYDFGRCPRVYCCGQSCLPVGQSDIPRASTVKIYCAKCEDVYYPRSKYQGNIDGAYFGATFPHLFLMTYGHLKPQKATQNYIPRVFGFKIHKP

SEQ ID NO: 8073 - protein, 276 aa, Arabidopsis thaliana
  misc_feature (1)..(276): Public GI ID NO.7576201
  misc_feature (90)..(264): Pfam Name: CK_II_beta Pfam Description: Casein kinase II regulatory subunit
  misc_feature (1)..(276): Functional Homolog of  Ceres ANNOT NO.555366
  misc_feature (1)..(276): useful for making plants with altered flowering time as described in USSN 12/281,616
MYKERSGGGGGGSSRSEILGGAIDRKRINDALNKKLEKSSTSTTTSRVFSSKDKDPFSFTSTKTQLPDVESETDSEGSDVSGSEGDDTSWISWFCNLRGNDFFCEVDEDYIQDDFNLCGLSGQVPYYDYALDLILDVDASNSEMFTDEQHEMVESAAEMLYGLIHVRYILTTKGMAAMTEKYKNCDFGRCPRVFCCGQSCLPVGQSDIPRSSTVKIYCPKCEDISYPRSKFQGNIDGAYFGTTFPHLFLMTYGNLKPQKPTQSYVPKIFGFKVHKP

SEQ ID NO: 8074 - protein, 260 aa, Zea mays
  misc_feature (1)..(260): Public GI ID NO.11527002
  misc_feature (72)..(247): Pfam Name: CK_II_beta Pfam Description: Casein kinase II regulatory subunit
  misc_feature (1)..(260): Functional Homolog of  Ceres ANNOT NO.555366 with e-value of 4.80E-106 and BLAST sequence identity of 74.1
  misc_feature (1)..(260): useful for making plants with altered flowering time as described in USSN 12/281,616
MDRKRIKDALEKHLERSSPSTSRGVVSKERERLAAGKLPSSLGKAEVSDGEEFETDSEDSDVSGSEGEDTSWISWFCTLRGNEFFCEIDDDYIQDDFNLCGLSNQVPYYDYALDLILDIESSNDDGFTEEQNELIESSAEMLYGLIHARYILTSKGLAAMLEKFKNYYDFGRCPRVYCCGQPCLPAGQSDVPRSSTVKIYCPKCEELNYPRSKYQGNIDGSYFGTTFPHLFLMTYPHLKPQKPSQQYTPRVFGFKLHKPS

SEQ ID NO: 8075 - protein, 280 aa, Nicotiana tabacum
  misc_feature (1)..(280): Public GI ID NO.21261784
  misc_feature (94)..(268): Pfam Name: CK_II_beta Pfam Description: Casein kinase II regulatory subunit
  misc_feature (94)..(268): Pfam Name: CK_II_beta Pfam Description: Casein kinase II regulatory subunit
  misc_feature (1)..(280): Functional Homolog of  Ceres ANNOT NO.555366 with e-value of 7.60E-124 and BLAST sequence identity of 85.5
  misc_feature (1)..(280): useful for making plants with altered flowering time as described in USSN 12/281,616
MYRDRGGGSSKSEIVGGPLDRKRINDALDKHLEKSSPSTSRAFKDKAVPSTSAGKSHQHHPDHRATKNKCSDDESETDSEESDVSGSDGEDTSWISWFCNLRGNEFFCEVDDEYIQDDFNLCGLSSQVPYYDYALDLILDVESSHGDMFTEEQNELVESAAEMLYGLIHVRYILTSKGMAAMLEKYKNYDFGRCPRVYCCGQPCLPVGQSDIPRSSTVKIYCPKCEDIYYPRSKYQGNIDGAYFGTTFPHLFLMTYGHLKPQKSTQNYVPRVFGFKLHKT

SEQ ID NO: 8076 - protein, 275 aa, Nicotiana tabacum
  misc_feature (1)..(275): Public GI ID NO.45238341
  misc_feature (94)..(263): Pfam Name: CK_II_beta Pfam Description: Casein kinase II regulatory subunit
  misc_feature (94)..(263): Pfam Name: CK_II_beta Pfam Description: Casein kinase II regulatory subunit
  misc_feature (1)..(275): Functional Homolog of  Ceres ANNOT NO.555366 with e-value of 6.89E-114 and BLAST sequence identity of 85.4
  misc_feature (1)..(275): useful for making plants with altered flowering time as described in USSN 12/281,616
MYRDRGGGGGGGGPLDRKRINDALDKHLEKLSPSTSRSLKDKAVPSTSASAGGGGGKSHFDHRNTSKNKCSDEESETDSEESDVSGSDGDDTSWISWFCNLRGNEFFCEVDDDYIQDDFNLCGLSSQVPYYDYALDLILDVESSHEEQNELVESAAEMLYGLIHVRYILTTKGMAAMLEKYKNYDFGRCPRVYCSGQPCLPVGQSDIPRSSTVKIYCPKCEDIYYPRSKYQGNIDGAYFGTTFPHLFLMTYGHLKPQKPTQNYTPRVFGFKIHKT

SEQ ID NO: 8077 - protein, 279 aa, Oryza sativa subsp. japonica
  misc_feature (1)..(279): Public GI ID NO.78709019
  misc_feature (92)..(266): Pfam Name: CK_II_beta Pfam Description: Casein kinase II regulatory subunit
  misc_feature (92)..(266): Pfam Name: CK_II_beta Pfam Description: Casein kinase II regulatory subunit
  misc_feature (1)..(279): Functional Homolog of  Ceres ANNOT NO.555366
  misc_feature (1)..(279): useful for making plants with altered flowering time as described in USSN 12/281,616
MSGAYRDRGFGGAAAEMDRKRIKDVLEKHLDRSSPSTSRGAAVAKERDRLAAAGGKLPAPLGKAGKVSDGEEFETDSEDSDVSGSEGEDTSWISWFCSLRGNEFFCEIDDDYIQDDFNLCGLSNQVPYYDYALDLILDIESSNGDVFTEEQNELIESSAEMLYGLIHARYILTSKGLAAMLEKFKNYDFGRCPRVYCCGQPCLPAGQSDIPRSSTVKIYCPKCEDLHYPRSKYQGNIDGAYFGTTFPHLFLMTYPHLKPQKPSQQYVPKVFGFKLHKQS

SEQ ID NO: 8078 - DNA, 643 bp, Glycine max
  misc_feature (1)..(643): Ceres CLONE ID no.535483
  misc_feature (1)..(643): useful for making plants with altered flowering time as described in USSN 12/281,616
atgattcatgctcgatatgtgttgaccagcaaaggaatggctgccatgcttgacaaatacaagagctatgattttggtagatgcccaagagtttactgctctggacagccctgccttccagttggtcaatcggacattcctaggtcaagtactgtgaaaatatactgccctaggtgtgaagatctttactatccgcgttccaagtatcaaggcaacattgatggagcttactttggaacaacatttccacacctcttcttgatgacttatggacaactgaagccacagaaaccagcacaaggctatgttccgagagtttttgggttcaaagttcacaagccataaagccgaagttgaagctttcatgaaagtaaaaatctccccgtgtctcatttaactcttcttatggttctctttgcaacaacaggcgaatcatatgctttccaaaccagtacaatctaggcatctgttttacttgttataggagcttgttgtaaagaaatatgcagacatgtgaagcaagtgcttagtttcagcttytgattcaatgagcaagtgcttaggtactcgatggkactttttaatggctttttacaaattgtattyttgcaattaacttaatattgtytawggttatgtytcg

SEQ ID NO: 8079 - protein, 261 aa, Glycine max; identical to SEQ ID NO: 8058
  misc_feature (1)..(261): Ceres CLONE ID NO.535483
  misc_feature (75)..(249): Pfam Name: CK_II_beta Pfam Description: Casein kinase II regulatory subunit
  misc_feature (75)..(249): Pfam Name: CK_II_beta Pfam Description: Casein kinase II regulatory subunit
  misc_feature (1)..(261): Functional Homolog of  Ceres ANNOT NO.555366
  misc_feature (1)..(261): useful for making plants with altered flowering time as described in USSN 12/281,616

SEQ ID NO: 8080 - DNA, 1286 bp, Triticum aestivum
  misc_feature (1)..(1286): Ceres CLONE ID no.702573
  misc_feature (1)..(1286): useful for making plants with altered flowering time as described in USSN 12/281,616
gaaattggcgccacctccctcccgtgctcgcccctcgcctgggctctcgacccatccctgctcgaaccctaacctcagatggcgcttcccgcgtgagagaacgctgccgcggcagcagcgttgaggggggcttcgtcgtagtcagcgcgacagatgtataagcagggggcggccggaggtgcggggccggaccggaagcgcatcagcgacgcgctcgataagcacctggagaaggcggccgcgtcgccctccacgtcgagaggctcggcgggtgcccgaggcaaccacaaccgcgtcgtagtgccgtcctccatccccaagggccgctgctccgaaggggagtctgaatctgacagtgaagcatcagatgttagtggctctgatggagaagacacctcatggatttcatggtattgcaacctaagagggaatgagttcttctgtgaagtcgatgatgattacattcaagatgacttcaatctttgtgggcttagcagtcaagttccatattatgattatgctcttgatctcattttagatatcgagtcttctcatggtgatattttcacagaagaacaaaatgagctagtggaatcagctgctgagatgttgtatgggctaattcatgcgcgatacattctgaccagtaaagggttggctgctatgctggagaaatacaagaactatgactttggacgatgtccacgggtttattgctgtggccaaccatgtctaccagttggacaatcggatattcaccgatctagtacagtgaagatatactgtcctaagtgcgaagacatctactatccacggtctaaataccaaggcaatattgatggagcctactttgggacaacatttcctcacctgtttctgatgacgtacgatcacctcaagccccagaagccctcgcagcgctatgttcctcgcgtatttggcttcaagctccacaaccacaagccatgatgcggaggtgaaggaaaagataagaggccccggaagactactgtaagagtgcaatcgccagatcatgctgcccacccatattgtgtgccctgtctggtctatttaacattgaaatattggtataaaagaagacatgagacgatgttgtaacctaattccagctctactggctagtaaatctggacctctgtttccaaaaccagcagctatcgagaaatcaaagttatggtcgaaaaaaaaaaaaaaaaaaaaaaaaaaaaaaaaaaaaaaaaaaaaaaaaaaaaaaaaaaaaaaaaaacccaaaaaaaaaaaaaaaa

SEQ ID NO: 8081 - protein, 271 aa, Triticum aestivum
  misc_feature (1)..(271): Ceres CLONE ID NO.702573
  misc_feature (83)..(257): Pfam Name: CK_II_beta Pfam Description: Casein kinase II regulatory subunit
  misc_feature (83)..(257): Pfam Name: CK_II_beta Pfam Description: Casein kinase II regulatory subunit
  misc_feature (1)..(271): Functional Homolog of  Ceres ANNOT NO.555366 with e-value of 4.09E-109 and BLAST sequence identity of 80.7
  misc_feature (1)..(271): useful for making plants with altered flowering time as described in USSN 12/281,616
MYKQGAAGGAGPDRKRISDALDKHLEKAAASPSTSRGSAGARGNHNRVVVPSSIPKGRCSEGESESDSEASDVSGSDGEDTSWISWYCNLRGNEFFCEVDDDYIQDDFNLCGLSSQVPYYDYALDLILDIESSHGDIFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYDHLKPQKPSQRYVPRVFGFKLHNHKP

SEQ ID NO: 8082 - DNA, 1282 bp, Zea mays
  misc_feature (1)..(1282): Ceres CLONE ID no.1222371
  misc_feature (1)..(1282): useful for making plants with altered flowering time as described in USSN 12/281,616
tctctaatttcctttctctctcaagcttctcagaaagtctgacactttcgagaatctaatctccaaatttcttgtctttttggagaaggaatcgaattatgtacaaggaacgtagtggaggaggtggtggtgggtcatcgagatcagagatcctcggtggagctattgatcggaaacgaatcaacgatgcactcaataagaaactagagaaatcttcaacttccaccaccacatctagggttttctcttctaaagacaaagatcccttttccttcacatctactaaaactcagcttcctgatgtggaatcggaaactgatagtgaagggtctgatgtgagtggatcggagggtgatgatacgtcgtggatctcttggttttgtaatttgagagggaatgatttcttctgtgaagtcgatgaagattatattcaagatgatttcaatctttgtggtttaagtggtcaagtcccttactatgattatgcacttgatctcattttagatgttgatgcttccaacagtgagatgtttactgatgaacagcatgaaatggtggaatcagctgctgagatgctatatggtcttattcatgttcgttacattttgactactaaaggaatggctgcaatgactgagaagtacaagaactgtgatttcgggagatgcccgagagttttctgttgcggtcagtcttgtcttccagttggacaatccgatatcccgagatcgagtactgtgaagatatactgccctaaatgcgaggatatatcttacccgcgatctaaattccaaggcaatattgatggagcgtactttggaaccacattccctcacttgttcttgatgacttacgggaacttaaagccgcagaagcctactcaaagctatgtcccaaaaatctttggcttcaaggtacacaaaccatgatactagtgctctgcattctcaatggatacatttagtggctctgtaattgcatccggatgagcaactgaaatgatagctgcggtgactggagcatacatcaaccattgggttagaggatgagagctgaagttgaaagatggaatcttgaaagaatctcatgaagttccaagaaaacttagaagtgcaacagcctggctcattgggggaaaagaacgacatacttgggtcttgttgttgtctccgaaaagattttccccagttagttggattttgttttgaactgttggattattattcgtttttctaatttcatgtaaaactcataaatttcaactgaagtataacttagatcg

SEQ ID NO: 8083 - protein, 276 aa, Zea mays; identical to SEQ ID NO: 8073
  misc_feature (1)..(276): Ceres CLONE ID NO.1222371
  misc_feature (90)..(264): Pfam Name: CK_II_beta Pfam Description: Casein kinase II regulatory subunit
  misc_feature (1)..(276): Functional Homolog of  Ceres ANNOT NO.555366 with e-value of 1.60E-130 and BLAST sequence identity of 90.4
  misc_feature (1)..(276): useful for making plants with altered flowering time as described in USSN 12/281,616

SEQ ID NO: 8084 - protein, 288 aa, Oryza sativa
  misc_feature (1)..(288): Public GI ID NO.34901776
  misc_feature (102)..(276): Pfam Name: CK_II_beta Pfam Description: Casein kinase II regulatory subunit
  misc_feature (102)..(276): Pfam Name: CK_II_beta Pfam Description: Casein kinase II regulatory subunit
  misc_feature (1)..(288): Functional Homolog of  Ceres ANNOT NO.555366
  misc_feature (1)..(288): useful for making plants with altered flowering time as described in USSN 12/281,616
MYKQGGGGGGGGGGGGGAGLDRKRISDALDKHLEKAVAAAAAAASPSTSRGSAGGRGGGDHQRLVVPSSASSMPKGRCSEGESESDSEASDVSGSDGEDHSWISWYCSLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYEHLKPQKPSQRYVPRVFGFKLHKP

SEQ ID NO: 8085 - DNA, 1305 bp, Arabidopsis thaliana
  misc_feature (1)..(1305): Ceres CLONE ID no.32842
  misc_feature (1)..(1305): Ceres LOCUS ID At5g52250
  misc_feature (1)..(1305): useful for making plants with altered flowering time as described in USSN 12/281,616
atagtttcgtgtggacctaactaaaactagtcgtaactcattcatggaggctttgttctgctctgagatacccaacaacaacatcagatcttccattaacgatctatcttcttcttcttcatatacatggccaatgatcatgacctcctcttcttcttcttcttcatctcccacaatcatgaacatagagaacattcctagatgcgactgggatctctctctttccgccgttgtttcctccgcatccaccggatcagacgctatcggagcaatcgagttcgaccctaccggagagatcatagctacgggaggaatcgcaagaaagatcagatcgtatcgtttaagctctttgttagagtcacgtgacgatcacgtaacagcttcagagagctgtatttgcacgccggcgaagcttagtagtctcaaatggagacccgatttttccggtcgggttatcgggtcaggagattacgacggagttgtcaccgagtacgacgtggagaaacaagtgcctgtttccgagagagacgagcatggaggtagaaggatttggagcgtggactacacgctttacaatggctctcttctaggcgcgtcaggctccgacgacggaacggttcaaatgtgggatccacgtaacggagggacgttagaagaaacggttaggcccggtggtggagcggcgatttgttcggtagagttcgatccgttcggtggatcttccatagccgttggatgtgctgaccagaatgcctacgtgtatgacatcagaagactagtggaccctttgatcgtattagacggccataccaaaacggtgacgtatgctcgattcatggattctcacacgatcgttaccggttcgaccgacgggagcttgaagcaatgggatatagataatggacggcgcgtggttcgcacgtaccgagggcatgtgaatagccggaactttgttgggttgtcggtttggagacatggtggtttggtcgtgtccgggtcagagaataaccaagtgtttgtgtacgataagaggtgggaggaaccggtttgggtttgtggattgggtcatacgaaccggtttggatctgaccgacggtttgttagtagtgtgtgtttgagacaagtggatgaagattggtgcacacttgtggccggaggatccgatggggctttagaaattttctcgggcaaacagagctaatcagtatttatattatttttttctgctcatgattaatacaaactgtttttcagttgattttatactgtctatagttattaattttaatatgattgaatgttact

SEQ ID NO: 8086 - protein, 385 aa, Arabidopsis thaliana
  misc_feature (1)..(385): Ceres CLONE ID NO.32842
  misc_feature (1)..(385): Ceres LOCUS ID At5g52250
  misc_feature (247)..(283): Pfam Name: WD40 Pfam Description: WD domain, G-beta repeat
  misc_feature (1)..(385): Functional Homolog of  PUBLIC GI NO.79518327 with e-value of 4.29E-113 and BLAST sequence identity of 67.1
  misc_feature (1)..(385): useful for making plants with altered flowering time as described in USSN 12/281,616
MEALFCSEIPNNNIRSSINDLSSSSSYTWPMIMTSSSSSSSSPTIMNIENIPRCDWDLSLSAVVSSASTGSDAIGAIEFDPTGEIIATGGIARKIRSYRLSSLLESRDDHVTASESCICTPAKLSSLKWRPDFSGRVIGSGDYDGVVTEYDVEKQVPVSERDEHGGRRIWSVDYTLYNGSLLGASGSDDGTVQMWDPRNGGTLEETVRPGGGAAICSVEFDPFGGSSIAVGCADQNAYVYDIRRLVDPLIVLDGHTKTVTYARFMDSHTIVTGSTDGSLKQWDIDNGRRVVRTYRGHVNSRNFVGLSVWRHGGLVVSGSENNQVFVYDKRWEEPVWVCGLGHTNRFGSDRRFVSSVCLRQVDEDWCTLVAGGSDGALEIFSGKQS

SEQ ID NO: 8087 - DNA, 1107 bp, Arabidopsis thaliana
  misc_feature (1)..(1107): Ceres ANNOT ID no.570714
  misc_feature (1)..(1107): Ceres LOCUS ID At5g23730
  misc_feature (1)..(1107): useful for making plants with altered flowering time as described in USSN 12/281,616
atgaacactcttcatcctcacaagcagcaacaagaacaagcacaacaacaagaagaagctagatacgaatgggatctttctctctccaccgtcgtatcttcctcctcctcctccgcctccgacgttatcggagctattgaattcgatcccactgataacatcgtcgctaccgccgggatttcaagaaagattcgtttttacggcctcccttctcttttacgtaacaacgctgtctccggtaccggagtttccttcgtcgatcaagccaccgcctgcgaatattacatctgtactccggcgaaacttagtagtctccggtggagacccgggtcgggcggtcgggttattgggtcgggagattacgacggcgtagtgatggagtacgatcttgagaagaggacgccggtattcgaaagggacgagcacggtggtcgtcgtgtatggagcgtagattacactcgtcacggcggcgcttcgacggtgggcgcgtcgggatcggatgacgggactatgcaagtatgggatccgaggtgtccgccggaagaatctgtcggtgttgtacgaccggcggggatttgccggagtgctgtttgttgcgtcgagttcgatccttccggtggaccagccgtggccgtcggatgcgctgatcggaaagggtacgtttacgatataaggaaactcgttgacccggcgttgactttacaaggtcatacgaaaacggtgtcgtatgtgaggttcctcgacggtgggacggtggtgacggcaggtacggacggttgtttgaagctgtggagcgtggaggatgggcgcgtgattcgcacgtacgaagggcatgtgaataatcggaacttcgtggggttatctgtgtggagaaacggcgcgttgtttggttgtggatcggaaaacaacagggtgtttgtgtacgataggagatgggggaagccggtttgggtagatgggtttgaaccagttggtatgaattctggttcggataagcggttcgtgagtagcgtctgttggaggcaatcaggtgtggaccagtgtaccctagtggctggaggatctgatggagtattacaggtttacgtgggcaaaagaaaaccatag

SEQ ID NO: 8088 - protein, 368 aa, Arabidopsis thaliana
  misc_feature (1)..(368): Ceres ANNOT ID NO.570714
  misc_feature (1)..(368): Ceres LOCUS ID At5g23730
  misc_feature (229)..(265): Pfam Name: WD40 Pfam Description: WD domain, G-beta repeat
  misc_feature (1)..(368): Functional Homolog of  Ceres CLONE NO.32842
  misc_feature (1)..(368): Functional Homolog of  PUBLIC GI NO.79518327 with e-value of 4.29E-113 and BLAST sequence identity of 67.1
  misc_feature (1)..(368): useful for making plants with altered flowering time as described in USSN 12/281,616
MNTLHPHKQQQEQAQQQEEARYEWDLSLSTVVSSSSSSASDVIGAIEFDPTDNIVATAGISRKIRFYGLPSLLRNNAVSGTGVSFVDQATACEYYICTPAKLSSLRWRPGSGGRVIGSGDYDGVVMEYDLEKRTPVFERDEHGGRRVWSVDYTRHGGASTVGASGSDDGTMQVWDPRCPPEESVGVVRPAGICRSAVCCVEFDPSGGPAVAVGCADRKGYVYDIRKLVDPALTLQGHTKTVSYVRFLDGGTVVTAGTDGCLKLWSVEDGRVIRTYEGHVNNRNFVGLSVWRNGALFGCGSENNRVFVYDRRWGKPVWVDGFEPVGMNSGSDKRFVSSVCWRQSGVDQCTLVAGGSDGVLQVYVGKRKP

SEQ ID NO: 8089 - DNA, 1215 bp, Oryza sativa
  misc_feature (1)..(1215): Ceres ANNOT ID no.1375154
  misc_feature (1)..(1215): useful for making plants with altered flowering time as described in USSN 12/281,616
atgagcaacccctcctcgccggccacgtccaccgccgccggggagcagcagctgcacgatcaggatcaccgggacgaggcggcgctgcagcaagaacacgccgccgccggcattattcccgacgacgaggacaagctgtcgccgccgaggtgcgaatgggagtttcgcctggcggccaccgtgccgtcgccggcgctcgcgggcgcgtccgactccatcggcagcctcgacttcgaccccaccggccgccacctcgccaccggcggcatcgcccggaagatccggatttacagggtcgccgagccgtctagccccgccgcctgcatctgcgtcccggccaagctgagcagcgtgcggtggcgccctggcggcggcgaggcggtggcggcgtcgcacgtggggtgcggcgactacgacggcgtcgtgacggagtacgacgtggagcgcggcgtgccggtctgggagcgcgacgagcacgaggggcggcgggtgtgggcgctcgactacgcccgcggcggcggcgcggcgacgatggtggcgtccgggtcggacgaccggacagcccacgtgtgggacccgcgcgccccggctggcgcggcggggtcgtgggcgacggcgcgcgccggcggcgccgtgctgtgcgtggagttcgaccccgccggcgggccgcagctggcggtgggctccgccgaccgccgcgccgcggtgcacgacgtgcgcgcgctggggcgcggcgcggtggcgtccatggacggccacggccgcgccgtgacgtacgtccggtgggcggcgacggcgcggcgggtggtgacgtcggcggcggacggcacccaccgtctgtgggcgctgccggcgccggcggcggcggagacggcggcgagggaggtgcggtcgtacagcggccacgtcagcgggcgaagcttcgtggggatgggggtgtggcgtggcgcggggctgatcgccagcggctccgagtccggccacgtcttcgtctacgacctccgctggtccaagcccatctgggtccacccattctcccacgccgacgccttcgtcagcgcggtcgcatggcgccagctcgccggcgacgacagcgacggccagctcgtcgccggcggctccgacggcgtgctcaagctcttcaccacccaccgccgtctcacccccgacgtcgccggcgtcgggggcgacgacgacgacgacgtggctgcatga

SEQ ID NO: 8090 - protein, 404 aa, Oryza sativa
  misc_feature (1)..(404): Ceres ANNOT ID NO.1375154
  misc_feature (1)..(404): Functional Homolog of  Ceres CLONE NO.32842 sequence identity of 67.2
  misc_feature (1)..(404): Functional Homolog of  PUBLIC GI NO.79518327 with e-value of 4.29E-113 and BLAST sequence identity of 67.1
  misc_feature (1)..(404): useful for making plants with altered flowering time as described in USSN 12/281,616
MSNPSSPATSTAAGEQQLHDQDHRDEAALQQEHAAAGIIPDDEDKLSPPRCEWEFRLAATVPSPALAGASDSIGSLDFDPTGRHLATGGIARKIRIYRVAEPSSPAACICVPAKLSSVRWRPGGGEAVAASHVGCGDYDGVVTEYDVERGVPVWERDEHEGRRVWALDYARGGGAATMVASGSDDRTAHVWDPRAPAGAAGSWATARAGGAVLCVEFDPAGGPQLAVGSADRRAAVHDVRALGRGAVASMDGHGRAVTYVRWAATARRVVTSAADGTHRLWALPAPAAAETAAREVRSYSGHVSGRSFVGMGVWRGAGLIASGSESGHVFVYDLRWSKPIWVHPFSHADAFVSAVAWRQLAGDDSDGQLVAGGSDGVLKLFTTHRRLTPDVAGVGGDDDDDVAA

SEQ ID NO: 8091 - DNA, 1368 bp, Populus balsamifera subsp. trichocarpa
  misc_feature (1)..(1368): Ceres ANNOT ID no.1474370
  misc_feature (1)..(1368): useful for making plants with altered flowering time as described in USSN 12/281,616
atgaaaaacttctccagtaaattccatccttatagtcatcagcacacacaagaatctcaaaaccaagaaacaagaaaacaaaaggaaaccatagaggaggaggaggaagaaagagcaaggtgtgaatgggatttcagtctctccacaatagtttcatcaagcaacaataacaacactgcatccatatcagatgctttaggggtgatcgaattcgaccagacgaatagcatcatcgccacagctaagcttagtagtttccgatggaaacccaggtcagacggtcgggttctagggtccggagactacgacggggtggtgatggaatataatcttgagaggagaataccaatctttgaacgcgatgaacatggcgggcgaagggtttggagcgtggactattcacattgcgatccgactatgggtgcatccgggtcggatgatggaaccatgcaaatgtgggacacacgcagtgagagtggggaatgtgtggctacggttcaacctagcgtgagacgcagtgccgtctgttgcgtggagtttaatccatttggtggaccaatagtagccatcggatgtgctgaccgcaaggtatacgggtatgatcttcgaatgatggctgacccagtatttgttcttgatgggcataggaagaccgtgacatacatcaaatttcttgataatgctacattagtatctgcaagcattgatggatgcttgaaactatggaattcggacaattcgaacgtaattcggacctaccacgggcacgtcaacaatcggaactttgttggattatcagtgtggaggaatggaggcttgctagggtgtggatcagaaaacaataaggtttttgtgtatgacaagagatggagtgaaccagtatgggttcacgagtctagtagcccaataatgggtaaagataggtgtggcagtgggtttgttagtagtgtgtgctggaggcaagtgggggaagaccaatgcacacttgtaacaggaggatcagatgggatcttgcaatgttccattaaattatttgcaattccatcacgtacgaaattcatccgacaaggactacagtttacatggcttattgagcgtgcaataacatcagtggagaatgcaaaagacaaaggagaaaaggaagagcagtggttggcggtggaaacggtagaggccggtggtgagctgctctccactgttcacatgcaacgtgaacaatggagaatgcaaaagacgaaggagaaggggaaggggaagggaaagaggaagaggaagagtagtggttggcggtggaaacgacggagggcggtgtttgcaactcagcacaaaaagcaacttcaagttgcttttggttgtcctgcggtttaa

SEQ ID NO: 8092 - protein, 455 aa, Populus balsamifera subsp. trichocarpa
  misc_feature (1)..(455): Ceres ANNOT ID NO.1474370
  misc_feature (207)..(243): Pfam Name: WD40 Pfam Description: WD domain, G-beta repeat
  misc_feature (1)..(455): Functional Homolog of  Ceres CLONE NO.32842 with e-value of 3.69E-87 and BLAST sequence identity of 62.5
  misc_feature (1)..(455): Functional Homolog of  PUBLIC GI NO.79518327 with e-value of 4.29E-113 and BLAST sequence identity of 67.1
  misc_feature (1)..(455): useful for making plants with altered flowering time as described in USSN 12/281,616
MKNFSSKFHPYSHQHTQESQNQETRKQKETIEEEEEERARCEWDFSLSTIVSSSNNNNTASISDALGVIEFDQTNSIIATAKLSSFRWKPRSDGRVLGSGDYDGVVMEYNLERRIPIFERDEHGGRRVWSVDYSHCDPTMGASGSDDGTMQMWDTRSESGECVATVQPSVRRSAVCCVEFNPFGGPIVAIGCADRKVYGYDLRMMADPVFVLDGHRKTVTYIKFLDNATLVSASIDGCLKLWNSDNSNVIRTYHGHVNNRNFVGLSVWRNGGLLGCGSENNKVFVYDKRWSEPVWVHESSSPIMGKDRCGSGFVSSVCWRQVGEDQCTLVTGGSDGILQCSIKLFAIPSRTKFIRQGLQFTWLIERAITSVENAKDKGEKEEQWLAVETVEAGGELLSTVHMQREQWRMQKTKEKGKGKGKRKRKSSGWRWKRRRAVFATQHKKQLQVAFGCPAV

SEQ ID NO: 8093 - DNA, 1437 bp, Populus balsamifera subsp. trichocarpa
  misc_feature (1)..(1437): Ceres ANNOT ID no.1527790
  misc_feature (1)..(1437): useful for making plants with altered flowering time as described in USSN 12/281,616
atgaaaaacttctccagtaaattccatccttatagtcatcagcacacacaagaatctcaaaaccaagaaacaagaaaacaaaaggaaaccatagaggaggaggaggaagaaagagcaaggtgtgaatgggatttcagtctctccacaatagtttcatcaagcaacaataacaacactgcatccatatcagatgctttaggggtgatcgaattcgaccagacgaatagcatcatcgccacagaccatgccagggctcgtgactattatatttgtaccccagctaagcttagtagtttccgatggaaacccaggtcagacggtcgggttctagggtccggagactacgacggggtggtgatggaatataatcttgagaggagaataccaatctttgaacgcgatgaacatggcgggcgaagggtttggagcgtggactattcacattgcgatccgactatgggtgcatccgggtcggatgatggaaccatgcaaatgtgggacacacgcagtgagagtggggaatgtgtggctacggttcaacctagcgtgagacgcagtgccgtctgttgcgtggagtttaatccatttggtggaccaatagtagccatcggatgtgctgaccgcaaggtatacgggtatgatcttcgaatgatggctgacccagtatttgttcttgatgggcataggaagaccgtgacatacatcaaatttcttgataatgctacattagtatctgcaagcattgatggatgcttgaaactatggaattcggacaattcgaacgtaattcggacctaccacgggcacgtcaacaatcggaactttgttggattatcagtgtggaggaatggaggcttgctagggtgtggatcagaaaacaataaggtttttgtgtatgacaagagatggagtgaaccagtatgggttcacgagtctagtagcccaataatgggtaaagataggtgtggcagtgggtttgttagtagtgtgtgctggaggcaagtgggggaagaccaatgcacacttgtaacaggaggatcagatgggatcttgcaatgttccattaaattatttgcaattccatcacgtacgaaattcatccgacaaggactacagtttacatggcttattgagcgtgcaataacatcagtggagaatgcaaaagacaaaggagaaaaggaagagcagtggttggcggtggaaacggtagaggccggtggtgagctgctctccactgttcacatgcaacgtgaacaatggagaatgcaaaagacgaaggagaaggggaaggggaagggaaagaggaagaggaagagtagtggttggcggtggaaacgacggagggcggtggtaaaacacattgcggttaaaaaaaaaaacaaattgcaccttaaagtggcaataaaaaaaaaagagaatgtgatttttacaagttaa

SEQ ID NO: 8094 - protein, 478 aa, Populus balsamifera subsp. trichocarpa
  misc_feature (1)..(478): Ceres ANNOT ID NO.1527790
  misc_feature (220)..(256): Pfam Name: WD40 Pfam Description: WD domain, G-beta repeat
  misc_feature (1)..(478): Functional Homolog of  Ceres CLONE NO.32842 with e-value of 4.80E-94 and BLAST sequence identity of 62.2
  misc_feature (1)..(478): Functional Homolog of  PUBLIC GI NO.79518327 with e-value of 4.29E-113 and BLAST sequence identity of 67.1
  misc_feature (1)..(478): useful for making plants with altered flowering time as described in USSN 12/281,616
MKNFSSKFHPYSHQHTQESQNQETRKQKETIEEEEEERARCEWDFSLSTIVSSSNNNNTASISDALGVIEFDQTNSIIATDHARARDYYICTPAKLSSFRWKPRSDGRVLGSGDYDGVVMEYNLERRIPIFERDEHGGRRVWSVDYSHCDPTMGASGSDDGTMQMWDTRSESGECVATVQPSVRRSAVCCVEFNPFGGPIVAIGCADRKVYGYDLRMMADPVFVLDGHRKTVTYIKFLDNATLVSASIDGCLKLWNSDNSNVIRTYHGHVNNRNFVGLSVWRNGGLLGCGSENNKVFVYDKRWSEPVWVHESSSPIMGKDRCGSGFVSSVCWRQVGEDQCTLVTGGSDGILQCSIKLFAIPSRTKFIRQGLQFTWLIERAITSVENAKDKGEKEEQWLAVETVEAGGELLSTVHMQREQWRMQKTKEKGKGKGKRKRKSSGWRWKRRRAVVKHIAVKKKNKLHLKVAIKKKENVIFTS

SEQ ID NO: 8095 - DNA, 1173 bp, Populus balsamifera subsp. trichocarpa
  misc_feature (1)..(1173): Ceres ANNOT ID no.1468856
  misc_feature (1)..(1173): useful for making plants with altered flowering time as described in USSN 12/281,616
atgaaaaacctctccactaaattccatcggcatagtcaccaccacacacaagaatctgaaaaccacgaaaaagaagccatagaggaagaacaagaacaacaagaagaaaaagctaggtgtgaatgggatttcagtctcacaacaattgtttcatcaggaaacaacaatatcagtagtactccagccatatcggatgctctaggggtgattgaattcgaccagacgaacagcatcattgccacaggtggaatagcaagaaagataagaatttacaacttcaagtctttgtttgcacatgaaaatactagccaaaatgcgcacgaaattacttgcttagaccatgctagggcttgtgactattatatttgtaccccagctaagcttagtagcatccgatggaaacccagttcggacgggcgggttctagggtccggagactacgacggggtggtgatggaatattgtcttgagaggagaataccaatcttcgaacgagatgaacatggcgggcgacgggtttggagtgtggactactcacattgggatccggttttgggtgcatccgggtcggatgatggaaccatgcaaatgtgggacacacgttgcgagagtggggagggcgtggctactgttcagcctggtgtgggtcgcagtgccgtgtgttgcgtggagttcaatccatttggtggaccaatagtagccgtcggatgcgctgacagaagggtatacgggtacgacattcgaatgacgggtgacccggtatttgttcttgatgggcataggaagaccgtgacgtacattaaatttctcgataatgttacattggtgtctgctagcattgatggatgcttgaagctatgggattcggataattcaaacgtaatccggtcatacaaggggcacgtcaacagccggagcttcatcggattgtcagtgtggaggaatggaggcttattagggtgtgggtcagaaaacaataaggtttttgtgtatgacagaagatggggcgagccaatatgggttcacgagtctaacccagtgggtagggatgggtgtggcggcgggttcgttagcagtgtgtgctggaggcaagtggaggaagaccagtgcacgctcgtggcaggaggatcagatggggacttgcaagtttttcaaggcagaaggaagtcatag

SEQ ID NO: 8096 - protein, 390 aa, Populus balsamifera subsp. trichocarpa
  misc_feature (1)..(390): Ceres ANNOT ID NO.1468856
  misc_feature (252)..(288): Pfam Name: WD40 Pfam Description: WD domain, G-beta repeat
  misc_feature (1)..(390): Functional Homolog of  Ceres CLONE NO.32842 with e-value of 9.39E-105 and BLAST sequence identity of 61.3
  misc_feature (1)..(390): Functional Homolog of  PUBLIC GI NO.79518327 with e-value of 4.29E-113 and BLAST sequence identity of 67.1
  misc_feature (1)..(390): useful for making plants with altered flowering time as described in USSN 12/281,616
MKNLSTKFHRHSHHHTQESENHEKEAIEEEQEQQEEKARCEWDFSLTTIVSSGNNNISSTPAISDALGVIEFDQTNSIIATGGIARKIRIYNFKSLFAHENTSQNAHEITCLDHARACDYYICTPAKLSSIRWKPSSDGRVLGSGDYDGVVMEYCLERRIPIFERDEHGGRRVWSVDYSHWDPVLGASGSDDGTMQMWDTRCESGEGVATVQPGVGRSAVCCVEFNPFGGPIVAVGCADRRVYGYDIRMTGDPVFVLDGHRKTVTYIKFLDNVTLVSASIDGCLKLWDSDNSNVIRSYKGHVNSRSFIGLSVWRNGGLLGCGSENNKVFVYDRRWGEPIWVHESNPVGRDGCGGGFVSSVCWRQVEEDQCTLVAGGSDGDLQVFQGRRKS

SEQ ID NO: 8097 - DNA, 1384 bp, Gossypium hirsutum
  misc_feature (1)..(1384): Ceres CLONE ID no.1919410
  misc_feature (1)..(1384): useful for making plants with altered flowering time as described in USSN 12/281,616
aatgaacgatttctcctccggattccatccccccgccgtcccaggccatgaaaccaaactatccgcagaagaaaaacaaccagccgctcgttgtgagtgggatttttcactcgccaccgttgtctcctccaccgccaacgccaccgtctctgacacccttggagtcatcgaattcgacccttctaataccatcttagcaaccggagggattgcaaggaagattaggatttacactttgaattctttgttgcggcctcaagaagagactgtccattctcaaggtaagcaccaaagtattgcgtttctagaccatactaatgcgtgtgataattgcatctttaccccagctaagcttagtagccttaggtggaaacccgggaccggaggccgcatcttgggttccggagactacgacggtgtggtcatggagtatgatatagagacgaagttgccaatcttcgaacgtgacgagcatggtgggaggcgggtttggagcgtcgactattctcattcggatccgttcctcggggcatctggctcggacgatggcaccatgcaaatgtgggacccacgctgcggcgaaggagggggaagtgtggctaaggtgcagcccacgaagtcacgcagctcggtttgttgcgtggagttcaaccccttcggagatgcattgatagccgccggatgcgccgacaagaaggcctacgtctatgatgtacggaaaatggtggagcccgtacacattttcgatggacatacgaaaaccataacatacgttagatttctgaatgcccaaacactggtttccgctggaaccgacgggtgtttaaaactatggaatatcgttgattctcgtttacttagaacatacaaagggcacgtaaacagtcggagctttgtggggttgtcagtttggaggcatggagggttgcttggatgcggatcagaaaataaccaggtgttcgtttatgataccaggtggggtgagcccatttgggtgcatggcttcgagcctgtgggtagagatagctccgaccatcagcatgctttcgtcagcagtgtgtgctggaggcaagtcaatgaagaccagtgcacacttgttgcaggtggttccaatggggttttacacgttttcgtgggcaagaggaaatctgattcagagtagcccatgtttggaaacatgaccttccttttcctctcatcttagggatcttatattactccaactaaaattttcatgtccatcaagaatgtaatattcaaagttgaatctgcattctccatattttactgttgtagcttatacttttcggttgaattataagatttgacactattatttaattaattaagaaaaaaaagggatggaggcccatcaaaggaaggc

SEQ ID NO: 8098 - protein, 386 aa, Gossypium hirsutum
  misc_feature (1)..(386): Ceres CLONE ID NO.1919410
  misc_feature (243)..(279): Pfam Name: WD40 Pfam Description: WD domain, G-beta repeat
  misc_feature (1)..(386): Functional Homolog of  Ceres CLONE NO.32842 with e-value of 9.99E-108 and BLAST sequence identity of 62.1
  misc_feature (1)..(386): Functional Homolog of  PUBLIC GI NO.79518327 with e-value of 4.29E-113 and BLAST sequence identity of 67.1
  misc_feature (1)..(386): useful for making plants with altered flowering time as described in USSN 12/281,616
MNDFSSGFHPPAVPGHETKLSAEEKQPAARCEWDFSLATVVSSTANATVSDTLGVIEFDPSNTILATGGIARKIRIYTLNSLLRPQEETVHSQGKHQSIAFLDHTNACDNCIFTPAKLSSLRWKPGTGGRILGSGDYDGVVMEYDIETKLPIFERDEHGGRRVWSVDYSHSDPFLGASGSDDGTMQMWDPRCGEGGGSVAKVQPTKSRSSVCCVEFNPFGDALIAAGCADKKAYVYDVRKMVEPVHIFDGHTKTITYVRFLNAQTLVSAGTDGCLKLWNIVDSRLLRTYKGHVNSRSFVGLSVWRHGGLLGCGSENNQVFVYDTRWGEPIWVHGFEPVGRDSSDHQHAFVSSVCWRQVNEDQCTLVAGGSNGVLHVFVGKRKSDSE

SEQ ID NO: 8099 - protein, 404 aa, Oryza sativa subsp. japonica; identical to SEQ ID NO: 8090
  misc_feature (1)..(404): Public GI ID NO.41052591
  misc_feature (245)..(282): Pfam Name: WD40 Pfam Description: WD domain, G-beta repeat
  misc_feature (1)..(404): Functional Homolog of  Ceres CLONE NO.32842 with e-value of 7.20E-75 and BLAST sequence identity of 52.6
  misc_feature (1)..(404): Functional Homolog of  PUBLIC GI NO.79518327 with e-value of 4.29E-113 and BLAST sequence identity of 67.1
  misc_feature (1)..(404): useful for making plants with altered flowering time as described in USSN 12/281,616

SEQ ID NO: 8100 - DNA, 1107 bp, Arabidopsis thaliana; identical to SEQ ID NO: 8087
  misc_feature (1)..(1107): Public GI ID NO.79518327
  misc_feature (1)..(1107): useful for making plants with altered flowering time as described in USSN 12/281,616

SEQ ID NO: 8101 - protein, 368 aa, Arabidopsis thaliana; identical to SEQ ID NO: 8088
  misc_feature (1)..(368): Public GI ID NO.79518327
  misc_feature (229)..(265): Pfam Name: WD40 Pfam Description: WD domain, G-beta repeat
  misc_feature (1)..(368): Functional Homolog of  Ceres CLONE NO.32842 with e-value of 4.29E-113 and BLAST sequence identity of 67.1
  misc_feature (1)..(368): Functional Homolog of  PUBLIC GI NO.79518327 BLAST sequence identity of67.2
  misc_feature (1)..(368): useful for making plants with altered flowering time as described in USSN 12/281,616

SEQ ID NO: 8102 - DNA, 665 bp, Arabidopsis thaliana
  misc_feature (1)..(665): Ceres CLONE ID no.251923
  misc_feature (1)..(665): Ceres LOCUS ID At1g57660
  misc_feature (1)..(665): useful for making plants with altered flowering time as described in USSN 12/281,616
aagggtttcgtcagagacagaagtgagagaggaggaaaaatgccggcgggacacggagtagggcgagaacaagagatctgttcgcgagaccattcaggaagaagggttatattccactctccacttacctcagaaccttcaaagtcggcgattacgtcgatgtcaaggttaatggagctatccacaagggtattcctcataagttctaccatggtcgtactggtcgcatctggaatgtcactaagcgtgccgttggtgttgaagtcaacaaacagattgggaacagaatcataaggaagaggatacatgtgcgtgtggagcatgtgcaacagtcaaggtgtgctgaggagtttaaactcagaaagaagcagaacgatgtgcttaaggctgatgctaaagccagaggagagactatcagcaccaagagacagcctaaaggtcctaaaccgggtttcatggtcgaaggtatgacattggagactgtcactcccattccttacgatgttgtcaacgatctcaagggtggttattgagttgtttccatttttttatcattctctactcagaatttttgcacttgcttttttaatgatgtttttgtatcaaacaagagtgaattctatatggtatgagttcatattttgttaggaaagatggtttatccc

SEQ ID NO: 8103 - protein, 164 aa, Arabidopsis thaliana
  misc_feature (1)..(164): Ceres CLONE ID NO.251923
  misc_feature (1)..(164): Ceres LOCUS ID At1g57660
  misc_feature (2)..(100): Pfam Name: Ribosomal_L21e Pfam Description: Ribosomal protein L21e
  misc_feature (1)..(164): useful for making plants with altered flowering time as described in USSN 12/281,616
MPAGHGVRARTRDLFARPFRKKGYIPLSTYLRTFKVGDYVDVKVNGAIHKGIPHKFYHGRTGRIWNVTKRAVGVEVNKQIGNRIIRKRIHVRVEHVQQSRCAEEFKLRKKQNDVLKADAKARGETISTKRQPKGPKPGFMVEGMTLETVTPIPYDVVNDLKGGY

SEQ ID NO: 8104 - DNA, 495 bp, Populus balsamifera subsp. trichocarpa
  misc_feature (1)..(495): Ceres ANNOT ID no.1447803
  misc_feature (1)..(495): useful for making plants with altered flowering time as described in USSN 12/281,616
atgccagctggacatggtttgcgatcaaggaccagagatctcttcgctcgtcccttcaggaagaagggttacatccctctcaccacatacctcagaacgtacaaggtaggcgactatgtcgacattaaggtaaatggcgctgtccacaaaggcatgccccacaagttctaccatggccgcaccggtcgcgtctggaatgtaaccaagcgcgctattggtgtcgtcatcaacaagcaggttgggaataggattattgggaagagaattcatgttagggtggagcatgtgcagccgtcgaggtgcagggaggagttcaagttgaggaagaagaagaatgatgagttgaaggcggaggccaaagctcgtggtgaaaagattagtactaagagacagcctcaaggaccgaagcccggatttatggtggagggtgctactcttgagactttcactcccattccttatgatgtggtcaatgatctcaagggtggttattga

SEQ ID NO: 8105 - protein, 164 aa, Populus balsamifera subsp. trichocarpa
  misc_feature (1)..(164): Ceres ANNOT ID NO.1447803
  misc_feature (2)..(100): Pfam Name: Ribosomal_L21e Pfam Description: Ribosomal protein L21e
  misc_feature (1)..(164): Functional Homolog of  Ceres CLONE NO.251923 with e-value of 5.20E-77 and BLAST sequence identity of 86.5
  misc_feature (1)..(164): useful for making plants with altered flowering time as described in USSN 12/281,616
MPAGHGLRSRTRDLFARPFRKKGYIPLTTYLRTYKVGDYVDIKVNGAVHKGMPHKFYHGRTGRVWNVTKRAIGVVINKQVGNRIIGKRIHVRVEHVQPSRCREEFKLRKKKNDELKAEAKARGEKISTKRQPQGPKPGFMVEGATLETFTPIPYDVVNDLKGGY

SEQ ID NO: 8106 - DNA, 616 bp, Arabidopsis thaliana
  misc_feature (1)..(616): Ceres CLONE ID no.251776
  misc_feature (1)..(616): Ceres LOCUS ID At1g09590
  misc_feature (1)..(616): useful for making plants with altered flowering time as described in USSN 12/281,616
atatataaaccctaatcacatttcgcaaccaccaaagcggaggaaaaatgccggctggacatggagttcgagcgagaacgagggatctgttcgcgaggcctttcaggaagaagggttacattcctctatcgacttacctgaggaccttcaaggtcggcgattacgtcgatgtgaaggtgaatggtgcgatccacaagggtatgcctcacaagttctaccatggtcgtactggtcgtatctggaacgtcaccaagcgcgccgtcggtgttgaagtcaacaaacagattgggaacaggatcataaggaagaggattcatgttcgtgtggagcatgtgcagcagtcaagatgtgccgaggagttcaagctgaggaagaagaaaaacgatgagctcaaggctgcagccaaagccaatggtgagaccatcagcaccaagagacagcctaaaggacccaaaccaggattcatggtcgaaggaatgaccttggagactgtcactccaatcccctacgatgtcgtcaacgatctcaaaggaggctattagttctatcttcttgtgctttagaactctttttcatatgttttgtagcagacttaaaactaagaattatgatttac

SEQ ID NO: 8107 - protein, 164 aa, Arabidopsis thaliana
  misc_feature (1)..(164): Ceres CLONE ID NO.251776
  misc_feature (1)..(164): Ceres LOCUS ID At1g09590
  misc_feature (1)..(164): Functional Homolog of  Ceres CLONE NO.251923 with e-value of 7.80E-83 and BLAST sequence identity of 96.9
  misc_feature (1)..(164): useful for making plants with altered flowering time as described in USSN 12/281,616
MPAGHGVRARTRDLFARPFRKKGYIPLSTYLRTFKVGDYVDVKVNGAIHKGMPHKFYHGRTGRIWNVTKRAVGVEVNKQIGNRIIRKRIHVRVEHVQQSRCAEEFKLRKKKNDELKAAAKANGETISTKRQPKGPKPGFMVEGMTLETVTPIPYDVVNDLKGGY

SEQ ID NO: 8108 - DNA, 788 bp, Zea mays
  misc_feature (1)..(788): Ceres CLONE ID no.303105
  misc_feature (1)..(788): useful for making plants with altered flowering time as described in USSN 12/281,616
aaaccctagcgccacccacccacccacccactcgcttcagccgcctccgccgcgcgtacaagcaggtggagacaggatgccggctggccacggcctgcgctcgcggacgcgcgacctcttcgcgcgccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcggcgtcgaggtcaacaagcaggtcaatgggcgcatcatcaggaagcgtatccatgtccgtgtggagcatgtgcagccgtcccgctgcacagaagagttccgcctgaggaaggcgaagaatgaccagctgaaggcggatgccaaaaagcgcggcgaggttatcagcaccaagaggcagccattgggtcccaagcccggcttcatggtcgagggcaccaccattgagaccgtaactcccatcccatatgatgtggtcaatgatctcaagggtggatactaggttgtttggtccatctacctgcagtacccagttctacatctgtgttactctagtgcgtgcaactttgctcactctgagcagtagtatgaacctgttgtctgttcctgttgaaagatttcccattttaggtgcaaacctgagtttctccgaacgcgttataccctgaccttgcttctgagaacgaagatgtgctatttttacaaaaaaaaaaaaaaaa

SEQ ID NO: 8109 - protein, 164 aa, Zea mays
  misc_feature (1)..(164): Ceres CLONE ID NO.303105
  misc_feature (2)..(100): Pfam Name: Ribosomal_L21e Pfam Description: Ribosomal protein L21e
  misc_feature (1)..(164): Functional Homolog of  Ceres CLONE NO.251923 with e-value of 1.80E-76 and BLAST sequence identity of 85.9
  misc_feature (1)..(164): useful for making plants with altered flowering time as described in USSN 12/281,616
MPAGHGLRSRTRDLFARPFRKKGYIPLTTYLRTYKIGDYVDVKVNGAVHKGMPHKFYHGRTGRVWNVTKRAIGVEVNKQVNGRIIRKRIHVRVEHVQPSRCTEEFRLRKAKNDQLKADAKKRGEVISTKRQPLGPKPGFMVEGTTIETVTPIPYDVVNDLKGGY

SEQ ID NO: 8110 - DNA, 745 bp, Glycine max
  misc_feature (1)..(745): Ceres CLONE ID no.661086
  misc_feature (1)..(745): useful for making plants with altered flowering time as described in USSN 12/281,616
aaaaaaaagagtgatccttctacactaactaaagccgagcagcgagagagagaaaccctagcaaaaatgccggctggtcacggtttgagatcccgcaccagagattccttctctcgtcccttcaggaagaagggtaccatcgccctcaccacatacctcagaacctaccacgtcggcgattatgtcgacgtcaaggttaacggcgccgtccacaagggaatgcctcacaagttctaccatggccgcaccggtcgcgtctggaatgtcaccaaacgtgctgttggggtcgaagtcaacaagcaggtcggcaacagaatcataaggaagaggattcacgtgcgtgtggagcatgttatgccatcaaggtgcactgaggagttccgccttaggaagatcaagaatgatcagctcaaggctgaggccaaggccaagggtgagaagatcagcaccaagagacagcctcagggtcccaaacctggtttcatggtcgagggggcaacgttggagacagttacccctattccctatgatgtcgtcaatgacctcaagggaggttattagtttcattctcgttgttggtctgcgtagttttttgtttggggattattagtccttttttgtgttggaagagaaacaattcagactattaaaatatttttgttgttttatttgatgttctaaatacatggatatgtttttgtttcgctcgtcataaatgtgctttttctcaaaaaaaaaaaaaaaa

SEQ ID NO: 8111 - protein, 164 aa, Glycine max
  misc_feature (1)..(164): Ceres CLONE ID NO.661086
  misc_feature (2)..(100): Pfam Name: Ribosomal_L21e Pfam Description: Ribosomal protein L21e
  misc_feature (1)..(164): Functional Homolog of  Ceres CLONE NO.251923 with e-value of 4.79E-74 and BLAST sequence identity of 84.7
  misc_feature (1)..(164): useful for making plants with altered flowering time as described in USSN 12/281,616
MPAGHGLRSRTRDSFSRPFRKKGTIALTTYLRTYHVGDYVDVKVNGAVHKGMPHKFYHGRTGRVWNVTKRAVGVEVNKQVGNRIIRKRIHVRVEHVMPSRCTEEFRLRKIKNDQLKAEAKAKGEKISTKRQPQGPKPGFMVEGATLETVTPIPYDVVNDLKGGY

SEQ ID NO: 8112 - DNA, 664 bp, Brassica napus
  misc_feature (1)..(664): Ceres CLONE ID no.873612
  misc_feature (1)..(664): useful for making plants with altered flowering time as described in USSN 12/281,616
aagggtttcagccaccaccacacagagaaagagagacagcgaaaatgccggcgggtcacggagtgagggcgagaaccagggatctgttcgcgagagggttcaggaagaagggtgttatcccactctctacctacctcaggaccttcaaagtcggtgattacgtggatgtgaaggtaaatggagccatccacaagggtatgcctcacaagttctaccatggtcgtactggtcgtgtctggaacgttactaagcgagctgttggtgtcgaagtcaacaagcagattggtaacagaatcataaggaagaggttgcatgtgcgtgtggagcacgtgcagcagtcaaggtgtgctgaggagtttaaactaaggaagaagaataacgatgtgctcaaggctgcagccaaagccagaggggagacaatcagcaccaagagacagcctaaaggtcccaagcctggtttcatggtcgagggtatgacattggagactgtcactcccatcccttacgatgttgtcaacgatctcaagggtggctattaagtttttcattttttttcttctatctgcccaagagtctttgcattttgttttttctttytgaatcaagactgctttttatattgtattaagtgatcgtttttcataatcatttgcttattgcgtcc

SEQ ID NO: 8113 - protein, 164 aa, Brassica napus
  misc_feature (1)..(164): Ceres CLONE ID NO.873612
  misc_feature (2)..(100): Pfam Name: Ribosomal_L21e Pfam Description: Ribosomal protein L21e
  misc_feature (1)..(164): Functional Homolog of  Ceres CLONE NO.251923 with e-value of 8.89E-82 and BLAST sequence identity of 95.7
  misc_feature (1)..(164): useful for making plants with altered flowering time as described in USSN 12/281,616
MPAGHGVRARTRDLFARGFRKKGVIPLSTYLRTFKVGDYVDVKVNGAIHKGMPHKFYHGRTGRVWNVTKRAVGVEVNKQIGNRIIRKRLHVRVEHVQQSRCAEEFKLRKKNNDVLKAAAKARGETISTKRQPKGPKPGFMVEGMTLETVTPIPYDVVNDLKGGY

SEQ ID NO: 8114 - DNA, 773 bp, Triticum aestivum
  misc_feature (1)..(773): Ceres CLONE ID no.1047389
  misc_feature (1)..(773): useful for making plants with altered flowering time as described in USSN 12/281,616
agcgccgcacacactccccccgcccgccgccgccgccgcacagccgcagggagagaaggcaaggaggaggaaggaaggggaagatgccggcggggcacgggctgcggtcgcggacgcgcgacctgttcgcgcggcccttccgtaagaaggggtacatcccgctcaccacctacctgcgcacctacaaggtcggggagcacgtcgacgtcaaggtgaacggcgccgtccacaagggcatgccgcacaagttctaccacggccgcaccggccgcgtctggaacgtcaccaagcgcgccatcggcgtcgagatcaacaagcaggtcggcaacaggatcatcaagaagaggatccatgtgcgtgtggagcacgtgcagccatccaggtgcaacgaggagttcctccagaggaaactcaacaatgacaagctgaaggcggaggccaaggcgcgtggcgaggtcatcagcacgaagaggcagccagcagggcccaagcctgggttcatggtggagggcaccaccatcgagacggtcacccccatcccgtacgacgtcgtcaacgatctcaagggtggttactagagcgcttgtttcctgagcagaagcttgagccagttcttagtatctatgcttgttcccaatgttttggtactgagtagttctctttttgctccgccgagtgtgaacttctctgtggttaacattaaagatttcctgtggttgatttcgttcttgacatgctgctggatatatttgcttttaaaaaaaaaaaaaaaa

SEQ ID NO: 8115 - protein, 164 aa, Triticum aestivum
  misc_feature (1)..(164): Ceres CLONE ID NO.1047389
  misc_feature (2)..(100): Pfam Name: Ribosomal_L21e Pfam Description: Ribosomal protein L21e
  misc_feature (1)..(164): Functional Homolog of  Ceres CLONE NO.251923 with e-value of 3.29E-75 and BLAST sequence identity of 84.7
  misc_feature (1)..(164): useful for making plants with altered flowering time as described in USSN 12/281,616
MPAGHGLRSRTRDLFARPFRKKGYIPLTTYLRTYKVGEHVDVKVNGAVHKGMPHKFYHGRTGRVWNVTKRAIGVEINKQVGNRIIKKRIHVRVEHVQPSRCNEEFLQRKLNNDKLKAEAKARGEVISTKRQPAGPKPGFMVEGTTIETVTPIPYDVVNDLKGGY

SEQ ID NO: 8116 - DNA, 710 bp, Glycine max
  misc_feature (1)..(710): Ceres CLONE ID no.1074340
  misc_feature (1)..(710): useful for making plants with altered flowering time as described in USSN 12/281,616
ggcgattttaggtttttagtttcgcagtaacccaagaggagaaaaaatgccggcgggacatggagttcgtgctaggacaagagatctgttcgcgagggggttcaggaagaagggtacaattccattgtctacctacctcaggaccttcaaggtcggagattacgtggatgttaaagtgaatggtgcgatccacaagggtatgcctcacaagttctaccacggtcgtaccggtcgtgtctggaacgttaccaaacgtgctgttggtgtcgaagtcaacaaacagattggcaacaggatcataaagaagaggcttcatgtgcgtgtggagcacgtgcagcagtcgaggtgcgctgaggagttcaagctgaggattaagaagaacgatgagctcaaggctgcagccaaggccaaaggcgagacaataagcaccaagaggcagcctaaaggacccaaaccagggtttatggttgaaggtatgaccttggagactgtcaccccaatcccttacgacgtcgtcaacgatctcaagggaggctattagtttttctacttctactttctacccccagtgttttgctcagactttttggcagtttcttttgcgaattctcgagtgttcttcgtgcgttttcgctacagttacattttctttaaggttcaatccagacataatgaaacaaaagttgcaatctccaaaaaaaaaaaaaaaa

SEQ ID NO: 8117 - protein, 164 aa, Glycine max
  misc_feature (1)..(164): Ceres CLONE ID NO.1074340
  misc_feature (1)..(164): Functional Homolog of  Ceres CLONE NO.251923 with e-value of 1.19E-79 and BLAST sequence identity of 93.2
  misc_feature (1)..(164): useful for making plants with altered flowering time as described in USSN 12/281,616
MPAGHGVRARTRDLFARGFRKKGTIPLSTYLRTFKVGDYVDVKVNGAIHKGMPHKFYHGRTGRVWNVTKRAVGVEVNKQIGNRIIKKRLHVRVEHVQQSRCAEEFKLRIKKNDELKAAAKAKGETISTKRQPKGPKPGFMVEGMTLETVTPIPYDVVNDLKGGY

SEQ ID NO: 8118 - DNA, 532 bp, Zea mays
  misc_feature (1)..(532): Ceres CLONE ID no.1375955
  misc_feature (1)..(532): useful for making plants with altered flowering time as described in USSN 12/281,616
tccaagggtttcagccaccaccacacagagaaagagagacagcgaaaatgccggcgggtcacggagtgagggcgagaaccagggatctgttcgcgagagggttcaggaagaagggtgttatcccactctctacctacctcaggaccttcaaagtcggtgattacgtggatgtgaaggtaaatggagccatccacaagggtatgcctcacaagttctaccatggtcgtactggtcgtgtctggaacgttactaagcgagctgttggtgtcgaagtcaacaagcagattggtaacagaatcataaggaagaggttgcatgtgcgtgtggagcacgtgcagcagtcaaggtgtgctgaggagtttaaactaaggaagaagaataacgatgtgctcaaggctgcagccaaagccagaggggagacaatcagcaccaagagacagcctaaaggtcccaagcctggtttcatggtcgagggtatgacattggagactgtcactcccatcccttacgatgttgtcaacgatctcaaggg

SEQ ID NO: 8119 - protein, 161 aa, Zea mays
  misc_feature (1)..(161): Ceres CLONE ID NO.1375955
  misc_feature (2)..(100): Pfam Name: Ribosomal_L21e Pfam Description: Ribosomal protein L21e
  misc_feature (1)..(161): Functional Homolog of  Ceres CLONE NO.251923 with e-value of 9.19E-80 and BLAST sequence identity of 95.6
  misc_feature (1)..(161): useful for making plants with altered flowering time as described in USSN 12/281,616
MPAGHGVRARTRDLFARGFRKKGVIPLSTYLRTFKVGDYVDVKVNGAIHKGMPHKFYHGRTGRVWNVTKRAVGVEVNKQIGNRIIRKRLHVRVEHVQQSRCAEEFKLRKKNNDVLKAAAKARGETISTKRQPKGPKPGFMVEGMTLETVTPIPYDVVNDLK

SEQ ID NO: 8120 - DNA, 715 bp, Zea mays
  misc_feature (1)..(715): Ceres CLONE ID no.1449006
  misc_feature (1)..(715): useful for making plants with altered flowering time as described in USSN 12/281,616
cttcggcgattttaaagttctgactggtcacatccaccaaagagacaaaaatgccggcaggacatggagttcgtgctcgaactagagatctgttcgctagagggttcaggaagaagggtacaattccactgtccacctacctaaggaccttcaaggtcggcgaatacgtcgatgttaaagtgaatggcgccatacacaagggtatgcctcataagttctaccatggtcgtactggtcgtgtctggaacgttaccaaacgtgccgttggtgtcgaagtcaacaaacagattggaaacaggatcataaagaagaggcttcatgtgcgtgtggagcatgtgcagcagtctagatgcgctgaggagttcaaactgaggataaagaagaacgatgagttgaaagctgcagccaaagccaaaggcgagacaataagcaccaagaggcagcctaaaggacccaaaccaggattcatggttgaaggtatgaccttggagaccgtcacccctatcccctacgacgttgtcaacgacctcaagggaggctattagttcttctctactttctttcctgttcttgctgtgtgttttggaactctgcatttgtagccacttgaactaagaatatgatttatatgagaattttgcaatccagtttgtttttatcatagttcaattttgtttgtcataaccattgattccaaccaaaaaaaaaaaaaaaa

SEQ ID NO: 8121 - protein, 164 aa, Zea mays
  misc_feature (1)..(164): Ceres CLONE ID NO.1449006
  misc_feature (2)..(100): Pfam Name: Ribosomal_L21e Pfam Description: Ribosomal protein L21e
  misc_feature (1)..(164): Functional Homolog of  Ceres CLONE NO.251923 with e-value of 3.10E-79 and BLAST sequence identity of 92.6
  misc_feature (1)..(164): useful for making plants with altered flowering time as described in USSN 12/281,616
MPAGHGVRARTRDLFARGFRKKGTIPLSTYLRTFKVGEYVDVKVNGAIHKGMPHKFYHGRTGRVWNVTKRAVGVEVNKQIGNRIIKKRLHVRVEHVQQSRCAEEFKLRIKKNDELKAAAKAKGETISTKRQPKGPKPGFMVEGMTLETVTPIPYDVVNDLKGGY

SEQ ID NO: 8122 - DNA, 684 bp, Zea mays
  misc_feature (1)..(684): Ceres CLONE ID no.1490319
  misc_feature (1)..(684): useful for making plants with altered flowering time as described in USSN 12/281,616
agttcggcggcttctatcagtttcacttgttcgcacgggaaaaaatgccggcaggacatggagttcgtgctagaacaagagatctgttcgcgagggggttcaggaagaagggtacaattccactgtccacctacctaaggaccttcaaggtcggcgaatacgtcgatgtcaaagtgaacggtgcgatacacaagggtatgcctcacaagttctaccacggtcgtactggtcgcgtctggaacgttaccaaacgtgccgttggtgtcgaagtcaacaaacagattggaaacaggatcataaagaagaggcttcatgtgcgtgtggagcacgtgcagcagtctagatgcgcggaagagttcaaactgaggataaggaagaacgatgagctcaaagctgctgctaaagcaagaggcgagacaataagcaccaagaggcagcctaaaggacccaaaccaggattcatggttgaaggtatgaccttggagacagtcactcctatcccctacgacgtcgtcaacgatctcaagggaggctattagttcttttctactttctctcctgttcttgctgtgtgttttggaactctgcatttgtagccacttgaactaaagaatatgatttatatgagaattttttggagtccagattttcattttgtgtggaatgttaaaaaaaaaaaaaaaa

SEQ ID NO: 8123 - protein, 164 aa, Zea mays
  misc_feature (1)..(164): Ceres CLONE ID NO.1490319
  misc_feature (2)..(100): Pfam Name: Ribosomal_L21e Pfam Description: Ribosomal protein L21e
  misc_feature (1)..(164): Functional Homolog of  Ceres CLONE NO.251923 with e-value of 3.10E-79 and BLAST sequence identity of 92.6
  misc_feature (1)..(164): useful for making plants with altered flowering time as described in USSN 12/281,616
MPAGHGVRARTRDLFARGFRKKGTIPLSTYLRTFKVGEYVDVKVNGAIHKGMPHKFYHGRTGRVWNVTKRAVGVEVNKQIGNRIIKKRLHVRVEHVQQSRCAEEFKLRIRKNDELKAAAKARGETISTKRQPKGPKPGFMVEGMTLETVTPIPYDVVNDLKGGY

SEQ ID NO: 8124 - DNA, 699 bp, Panicum virgatum
  misc_feature (1)..(699): Ceres CLONE ID no.1781890
  misc_feature (1)..(699): useful for making plants with altered flowering time as described in USSN 12/281,616
ctcgctaaccctagcccccgcctcccacctgctccccgccgccgccgccgccgcaagtaggaccagccaggatgccggccggccacgggctgcgctcgcggacgcgcgacctcttcgcgcgtcccttccgcaagaaggggtacatcccgctcaccacctacctccgcaccttcaagatcggcgactacgtcgacgtcaaggtgaacggcgccgtccacaaggggatgccgcacaagttctaccacggccgcaccggtcgcgtgtggaacgtcactaagcgcgccatcggcgttgagatcaacaagcaggttaatggccgcatcatcaggaagcgtatccatgtccgtgtggagcatgtgcagcagtcccgctgcactgaggagttccgccagaggaaggcaaagaatgaccagctgaaagcagatgccaaggcacgcggtgaggtcatcagcaccaagaggcagccattgggtcccaagcctggcttcatggttgaaggtgctaccatcgagaccgtcacccccatcccatatgatgttgtcaacgatctcaagggcggttactaggttgctcggtctatctagccgcactaccagttctatatctgtattactctagtgggtacaattttgctctgtccgagcagtagtctggtcctattctgtgtgtttctgttgaaagattttccattctaggtgc

SEQ ID NO: 8125 - protein, 164 aa, Panicum virgatum
  misc_feature (1)..(164): Ceres CLONE ID NO.1781890
  misc_feature (1)..(164): Functional Homolog of  Ceres CLONE NO.251923 with e-value of 3.19E-77 and BLAST sequence identity of 86.5
  misc_feature (1)..(164): useful for making plants with altered flowering time as described in USSN 12/281,616
MPAGHGLRSRTRDLFARPFRKKGYIPLTTYLRTFKIGDYVDVKVNGAVHKGMPHKFYHGRTGRVWNVTKRAIGVEINKQVNGRIIRKRIHVRVEHVQQSRCTEEFRQRKAKNDQLKADAKARGEVISTKRQPLGPKPGFMVEGATIETVTPIPYDVVNDLKGGY

SEQ ID NO: 8126 - protein, 164 aa, Arabidopsis thaliana; identical to SEQ ID NO: 8107
  misc_feature (1)..(164): Public GI ID NO.3482935
  misc_feature (2)..(100): Pfam Name: Ribosomal_L21e Pfam Description: Ribosomal protein L21e
  misc_feature (1)..(164): Functional Homolog of  Ceres CLONE NO.251923
  misc_feature (1)..(164): useful for making plants with altered flowering time as described in USSN 12/281,616

SEQ ID NO: 8127 - protein, 164 aa, Oryza sativa subsp. japonica
  misc_feature (1)..(164): Public GI ID NO.3885884
  misc_feature (2)..(100): Pfam Name: Ribosomal_L21e Pfam Description: Ribosomal protein L21e
  misc_feature (1)..(164): Functional Homolog of  Ceres CLONE NO.251923 with e-value of 4.10E-77 and BLAST sequence identity of 86.5
  misc_feature (1)..(164): useful for making plants with altered flowering time as described in USSN 12/281,616
MPADHGLRARTRDLFARPFRKKGYIPLTTYLRTYKIGEHVDVKVNGAVHKGMPHKFYHGRTGRVWNVTKRAIGVEINKQVGNRIIRKRIHVRVEHVQPSRCTEEFRLRKIKNDQLKADAKARGEVISTKRQPQGPKPGFMVEGATLETVTPIPYDVVNDLKGGY

SEQ ID NO: 8128 - DNA, 495 bp, Populus balsamifera subsp. trichocarpa
  misc_feature (1)..(495): Ceres ANNOT ID no.1475022
  misc_feature (1)..(495): useful for making plants with altered flowering time as described in USSN 12/281,616
atgccggctggtcacggtctccggtctcgcactagagatctcttcgctcgtccctttagaaagaagggttacattccattgacaacctacctcagaacctataagattggagaccatgtagacgttaaggttaacggcgccgtccacaagggtatgcctcacaagttttaccatggacgtactggcagagtctggaatgtcaccaaacgtgccatcggcgtagaggtcaacaagcaggtgggtaacaggatcatcaggaagaggatccatgtcagagtggaacatttgctaccctcaaggtgcactgaggaattccgtctcaggaagaagaagaatgatcaactaaaggcagaggctaaggccagaggtgaggttatctgcacaaagaggcagccagagggtcctaaacctggtttcatggtggaaggtgctacattggaaactgttactcccattccatatgatgttgttaacgatctcaagggaggttattag

SEQ ID NO: 8129 - protein, 164 aa, Populus balsamifera subsp. trichocarpa
  misc_feature (1)..(164): Ceres ANNOT ID NO.1475022
  misc_feature (2)..(100): Pfam Name: Ribosomal_L21e Pfam Description: Ribosomal protein L21e
  misc_feature (1)..(164): Functional Homolog of  Ceres CLONE NO.251923 with e-value of 6.69E-77 and BLAST sequence identity of 85.9
  misc_feature (1)..(164): useful for making plants with altered flowering time as described in USSN 12/281,616
MPAGHGLRSRTRDLFARPFRKKGYIPLTTYLRTYKIGDHVDVKVNGAVHKGMPHKFYHGRTGRVWNVTKRAIGVEVNKQVGNRIIRKRIHVRVEHLLPSRCTEEFRLRKKKNDQLKAEAKARGEVICTKRQPEGPKPGFMVEGATLETVTPIPYDVVNDLKGGY

SEQ ID NO: 8130 - DNA, 686 bp, Glycine max
  misc_feature (1)..(686): Ceres CLONE ID no.511820
  misc_feature (1)..(686): useful for making plants with altered flowering time as described in USSN 12/281,616
ggcaaaccctagtgcttcccaccgatccatttcagccgccgccgcgcgtagcaagcaggagcagcaaggatgccggctggccacgggctgcgctcgcggacgcgcgacctgttcgcgcgccccttccgcaagaagggctacatcccgctcaccacctacctccgcacctacaagatcggcgactacgtcgacgtcaaggtgaacggcgccgtccacaaggggatgccgcacaagttctaccacggccgcaccggtcgcgtctggaacgtcaccaagcgcgccatcggcgtcgagataaacaagcaggtgaatggtcgcatcatcaggaagcgtatccatgtccgcgtggagcatgtgcagccgtcccgctgcacagaagagttccgcctgaggaaggtgaagaatgatcagctgaaggcggatgcaaaggagcgcggcgaggtcatcagcaccaagaggcagccgttgggtcccaagcctggcttcatggttgaggggactaccatcgagaccgtcactcccatcccgtacgatgtggtcaatgatcttaagggcggatactaggttgtttgtttggtctttctacctgttctacatctgtgttactctagtgcgtacaattttgctcacactgagcagtagtatgaacctattgtgtgttcatgttgaaaaaaaaaaaaaaaaaa

SEQ ID NO: 8131 - protein, 164 aa, Glycine max
  misc_feature (1)..(164): Ceres CLONE ID NO.511820
  misc_feature (2)..(100): Pfam Name: Ribosomal_L21e Pfam Description: Ribosomal protein L21e
  misc_feature (1)..(164): Functional Homolog of  Ceres CLONE NO.251923 with e-value of 2.90E-76 and BLAST sequence identity of 85.3
  misc_feature (1)..(164): useful for making plants with altered flowering time as described in USSN 12/281,616
MPAGHGLRSRTRDLFARPFRKKGYIPLTTYLRTYKIGDYVDVKVNGAVHKGMPHKFYHGRTGRVWNVTKRAIGVEINKQVNGRIIRKRIHVRVEHVQPSRCTEEFRLRKVKNDQLKADAKERGEVISTKRQPLGPKPGFMVEGTTIETVTPIPYDVVNDLKGGY

SEQ ID NO: 8132 - DNA, 261 bp, Triticum aestivum
  misc_feature (1)..(261): Ceres CLONE ID no.1316006
  misc_feature (204)..(204): n is a, c, t, g, unknown, or other
  misc_feature (212)..(212): n is a, c, t, g, unknown, or other
  misc_feature (1)..(261): useful for making plants with altered flowering time as described in USSN 12/281,616
ctagcgccgcacacactccccccgcccgccgccgccgccgcacagccgcagggagagaaggcaaggaggaggaaggaaggggaagatgccggcggggcacgggctgcggtcgcggacgcgcgacctgttcgcgcggcccttccgtaagaaggggtacatcccgctcaccacctacctgcgcacctacaaggtcggggagcacgncgacgtcnaggtgaacggcgccgtccacaagggcatgccgcacaagttctaccacgg

SEQ ID NO: 8133 - protein, 164 aa, Triticum aestivum; identical to SEQ ID NO: 8115
  misc_feature (1)..(164): Ceres CLONE ID NO.1316006
  misc_feature (2)..(100): Pfam Name: Ribosomal_L21e Pfam Description: Ribosomal protein L21e
  misc_feature (1)..(164): Functional Homolog of  Ceres CLONE NO.251923 and BLAST sequence identity of 84.8
  misc_feature (1)..(164): useful for making plants with altered flowering time as described in USSN 12/281,616

SEQ ID NO: 8134 - DNA, 677 bp, Zea mays
  misc_feature (1)..(677): Ceres CLONE ID no.1445194
  misc_feature (1)..(677): useful for making plants with altered flowering time as described in USSN 12/281,616
ggcgatttttaggtttctacttgtcgcatccaccaaagaggaaaaatgccggcgggtcatggagttcgcgctaggacgagggatctgttcgcgagggggttcaggaagaagggtacaatcccactgtcgacttacctcaggaccttcaaggtcggcgattacgtggatgtcaaggtgaacggtgcgatccacaagggtatgcctcacaagttctaccacggtcgtaccggtcgtgtctggaacgtcaccaagcgagccgtcggtgtcgaagtcaacaaacagattggaaacaggatcattaggaagaggcttcatgtgcgtgtggagcacgtgcagcaatccaggtgtgcagaggagttcaagctgaggattaagaagaatgatgagctcaaggccgcagccaaagccagaggtgagacaataagcaccaagagacagcctaaaggccccaagccaggattcatggttgagggtatgaccttggagactgtcaccccaatcccctacgacgtcgtcaacgatctcaagggaggctattagttctactttcttccctcccagcgttttggagctttctttcatatggtttgtagcgacttaatactactggaagatgattttaaacagcatgagttttgttattgataccattgtgtctgccaaaaaaaaaaaaaaaa

SEQ ID NO: 8135 - protein, 164 aa, Zea mays
  misc_feature (1)..(164): Ceres CLONE ID NO.1445194
  misc_feature (2)..(100): Pfam Name: Ribosomal_L21e Pfam Description: Ribosomal protein L21e
  misc_feature (1)..(164): Functional Homolog of  Ceres CLONE NO.251923 with e-value of 2.70E-80 and BLAST sequence identity of 94.5
  misc_feature (1)..(164): useful for making plants with altered flowering time as described in USSN 12/281,616
MPAGHGVRARTRDLFARGFRKKGTIPLSTYLRTFKVGDYVDVKVNGAIHKGMPHKFYHGRTGRVWNVTKRAVGVEVNKQIGNRIIRKRLHVRVEHVQQSRCAEEFKLRIKKNDELKAAAKARGETISTKRQPKGPKPGFMVEGMTLETVTPIPYDVVNDLKGGY

SEQ ID NO: 8136 - protein, 164 aa, Oryza sativa subsp. japonica
  misc_feature (1)..(164): Public GI ID NO.31432571
  misc_feature (2)..(100): Pfam Name: Ribosomal_L21e Pfam Description: Ribosomal protein L21e
  misc_feature (1)..(164): Functional Homolog of  Ceres CLONE NO.251923
  misc_feature (1)..(164): useful for making plants with altered flowering time as described in USSN 12/281,616
MPAGHGLRARTRDLFARPFRKKGYIPLTTYLRTYKIGEHVDVKVNGAVHKGMPHKFYHGRTGRVWNVTKRAIGVEINKQVGNRIIRKRIHVRVEHVQPSRCTEEFRLRKIKNDQLKADAKARGEVISTKRQPQGPKPGFMVEGATLETVTPIPYDVVNDLKGGY

SEQ ID NO: 8137 - DNA, 1648 bp, Arabidopsis thaliana
  misc_feature (1)..(1648): Ceres CLONE ID no.149496
  misc_feature (1)..(1648): Ceres LOCUS ID At1g04990
  misc_feature (1)..(1648): useful for making plants with altered flowering time as described in USSN 12/281,616
aattctctgtctgtgataaaagaaaaattgaatttttttcttctatctatctacctctgttcttcctcgtcatttcttacccagaaaaatagaggataacaaaaatctgtttctttcgatgatcatcgtgacactttctctgtgatttttcctttcttctgttgttgttgatcatcgtgatcatcgtctttccttacatgcgaacccccatgtcagacactcagcatgtacagagctctttggtgtcgattcgatcttccgacaaaatcgaagatgcctttaggaagatgaaagtaaatgagaccggcgtggaggaactgaatccgtatccagatcgtcccggtgaaagagattgccaattctatttaagaactggtctctgtggctatggaagcagttgccgttacaatcatcctactcatcttccacaggatgttgcttattacaaggaggagctccctgagagaattggacagccggattgtgagtattttctgaagacaggagcttgtaagtacggcccaacttgtaaatatcatcatccaaaggacaggaacggtgcacaacctgtaatgttcaatgttatcggtttacctatgcgtctgggtgagaagccatgtccatattacctgcgaacgggaacttgcagattcggagttgcttgcaaattccaccatcctcaacctgataatggacattctactgcatatggaatgtctagctttcctgctgcagatttacgatatgctagtggtttaacaatgatgtctacatatggaactttgcctcgtccgcaagttccccagtcctatgtgccaatcctggtttcaccctctcaaggctttttacctcctcaaggctgggccccttacatggctgcatctaactccatgtacaatgtgaagaatcaaccttattactccggtagtagtgcatccatggccatggctgtggcattgaaccgtggtttgtcagaaagttctgaccaaccagaatgtcggttttttatgaacaccgggacatgtaaatacggagacgattgcaaatacagccatcccggagtaaggatttcacaaccaccaccaagtcttataaaccctttagttcttccagcgagacctggacaaccagcttgtggtaacttcaggtcttatggattctgcaagtttggaccaaactgcaaattcgaccaccctatgctgccatatccgggcctgaccatggctacttctctgcctactccttttgcttcacctgttacaacccatcagaggatctcaccaacaccaaaccgctctgattcaaagtctctttctaatggtaaacctgatgtgaagaaagaaagctcagagactgagaaaccagacaatggagaagtgcaggatttgtctgaggatgcgtcatcaccatgatcatgattcttaaaaaccccaatgatctctctctgcccttttttgtggaagaggaggggaggtgaaaagtgtttctcttttctttttttttcttttttttttggcttggagatggccatggctgaaaacaatataggatgaaaccagtgatgttgtcacaggtttctcttctgtttttgactctgttaataaattttaatcagacttatcagaggaaaaatagagtttgtgttgtg

SEQ ID NO: 8138 - protein, 404 aa, Arabidopsis thaliana
  misc_feature (1)..(404): Ceres CLONE ID NO.149496
  misc_feature (1)..(404): Ceres LOCUS ID At1g04990
  misc_feature (136)..(162): Pfam Name: zf-CCCH Pfam Description: Zinc finger C-x8-C-x5-C-x3-H type (and similar)
  misc_feature (1)..(404): useful for making plants with altered flowering time as described in USSN 12/281,616
MRTPMSDTQHVQSSLVSIRSSDKIEDAFRKMKVNETGVEELNPYPDRPGERDCQFYLRTGLCGYGSSCRYNHPTHLPQDVAYYKEELPERIGQPDCEYFLKTGACKYGPTCKYHHPKDRNGAQPVMFNVIGLPMRLGEKPCPYYLRTGTCRFGVACKFHHPQPDNGHSTAYGMSSFPAADLRYASGLTMMSTYGTLPRPQVPQSYVPILVSPSQGFLPPQGWAPYMAASNSMYNVKNQPYYSGSSASMAMAVALNRGLSESSDQPECRFFMNTGTCKYGDDCKYSHPGVRISQPPPSLINPLVLPARPGQPACGNFRSYGFCKFGPNCKFDHPMLPYPGLTMATSLPTPFASPVTTHQRISPTPNRSDSKSLSNGKPDVKKESSETEKPDNGEVQDLSEDASSP

SEQ ID NO: 8139 - DNA, 1694 bp, Triticum aestivum
  misc_feature (1)..(1694): Ceres CLONE ID no.833872
  misc_feature (1)..(1694): useful for making plants with altered flowering time as described in USSN 12/281,616
cccctctctccctctgtatcctgcacacaccgccaccgatcactcgccggagcccctcccccaatggccgccgccgccgccgcgatcgcgtgatggccgacccagccgctcgccgaagatggacgaagccggaagggcctccgctcccgcggtggtgacggtcacggcctccgccgccgccccctcgcctcctcctcccccgccccccgccacggccaccgccgcggccgccgacccgccatcgcccgacccggacgctctctatgaagagggaatgtggcagcagatggccatgagcagcggcgccactatgcaatctgggccatatcctgtgcggccaggggaaccggactgcacctactacctcaggactggattgtgcaggttcggcatgagctgcaggttcaatcaccctcaggacaggaatacggctattgcctctgccagaatgaaaggagaatatcctgagagggtgggacaacctgaatgtcagtactatctgaagactggaacatgcaagtttgggcctacgtgcaaattccatcaccctagagaaaaggctggaatcgcaggaatggtgcagctaaacacattgggatatccacttcgaccgaatgaaagggagtgtgcatactacttaaaaacgggacagtgtaaatatgggaatacatgtaaatttaaccatccagaaattttcaatgcggtggcttcttcacgtggttcccctatttatcctcctgtacataactctggaagcaccggtccacattcctatactggaacaatggcaagctggacttatccaagaggttctttcattccaagccctagatggcaaagtccttcaaactatacaccgatgattgtaccacagggtcttgttcaagtaccaaactggaactcatatcctggccaaatggtacctgtttcatctcctgagagtcgactacagtctccaggggctcaacaatactatggaacttctcgacaaggtgaagccagtgcaggaaatcagggaatgcaatcaccctacagatccagttcgtttcctgcacctcagtatgcactgcagagagagaatgtatttcctgagagacctgatcagccagaatgcatatactacataaagactggagattgtaaatttggtgcggtttgcaaattccatcatccccgggtgcgctcacagcctcccccagactgtatcttgagcccaatgggtcttccattacgcccaggcgaagagctctgcaagttctactctcgctatggcatctgcaagttcggcgtaaactgcaagttcgaccatccaatggcggctccgatgggggtctacgcgtacggctactctgcctcggcgtcgcccaacgcgcccatgggtcggcgtctcctggagtccccctccgggtctgcgtacgcctcctaaggcaaggctccctggcatttgaccctaccttgattgatctcgatgatgtataaaagccatcgcgagctgtcgtccctccctcgggcgcgccccgcgaatgttctcccccctaactccccggaatcaagttctgtaaaaatcgagtttgctaccagagatgtacagttgttatttttgttaatgcgggtcagtgtttggatggatggagaagccatttgctaccgaatgaaataatgcttgaatgcagtgttgaaaaaaaaaaaaaaaa

SEQ ID NO: 8140 - protein, 435 aa, Triticum aestivum
  misc_feature (1)..(435): Ceres CLONE ID NO.833872
  misc_feature (373)..(399): Pfam Name: zf-CCCH Pfam Description: Zinc finger C-x8-C-x5-C-x3-H type (and similar)
  misc_feature (1)..(435): Functional Homolog of  Ceres CLONE NO.149496 with e-value of 6.30E-65 and BLAST sequence identity of 47.2
  misc_feature (1)..(435): useful for making plants with altered flowering time as described in USSN 12/281,616
MDEAGRASAPAVVTVTASAAAPSPPPPPPPATATAAAADPPSPDPDALYEEGMWQQMAMSSGATMQSGPYPVRPGEPDCTYYLRTGLCRFGMSCRFNHPQDRNTAIASARMKGEYPERVGQPECQYYLKTGTCKFGPTCKFHHPREKAGIAGMVQLNTLGYPLRPNERECAYYLKTGQCKYGNTCKFNHPEIFNAVASSRGSPIYPPVHNSGSTGPHSYTGTMASWTYPRGSFIPSPRWQSPSNYTPMIVPQGLVQVPNWNSYPGQMVPVSSPESRLQSPGAQQYYGTSRQGEASAGNQGMQSPYRSSSFPAPQYALQRENVFPERPDQPECIYYIKTGDCKFGAVCKFHHPRVRSQPPPDCILSPMGLPLRPGEELCKFYSRYGICKFGVNCKFDHPMAAPMGVYAYGYSASASPNAPMGRRLLESPSGSAYAS

SEQ ID NO: 8141 - protein, 249 aa, Pisum sativum
  misc_feature (1)..(249): Public GI ID NO.5616313
  misc_feature (27)..(77): Pfam Name: SRF-TF Pfam Description: SRF-type transcription factor
  misc_feature (93)..(192): Pfam Name: K-box Pfam Description: K-box region
  misc_feature (1)..(249): Functional Homolog of  Ceres CLONE NO.149496 BLAST sequence identity of 47.4
  misc_feature (1)..(249): useful for making plants with altered flowering time as described in USSN 12/281,616
MAYENKPNTDLDADAQRRLGRGKIEIKRIENTTNRQVTFCKRRNGLLKKAYELSVLCDAEVALIVFSNRGRLYEYSNNSSVRETIERYKKACADTSTNGSASEATTQYYQQEAAKLHNQINALQNINRGYMAEGLSNKNIKELKGMERKLERAITRIRSKKNELLFAEIEYMQKRELDLHNNNQLLRAKIAENERQQQSIIAITGGHGSYEIVQPTQPFHEARNYFQVNALQPNIHQYSCHDQVSLQLV

SEQ ID NO: 8142 - protein, 494 aa, Oryza sativa
  misc_feature (1)..(494): Public GI ID NO.77550853
  misc_feature (406)..(432): Pfam Name: zf-CCCH Pfam Description: Zinc finger C-x8-C-x5-C-x3-H type (and similar)
  misc_feature (1)..(494): Functional Homolog of  Ceres CLONE NO.149496 BLAST sequence identity of 42.4
  misc_feature (1)..(494): useful for making plants with altered flowering time as described in USSN 12/281,616
MAAAPSAGGVGEGSSSSAAAAAAAAAATIGPHVVDEGALCFGHSHNADMFYNVDTLSVIDGMVVITTQNFELQYIKGLWRIWQATPLMGRISFGAAREGLSAAATAVAVAASVIGPHSSDEEAMWQMNLGEAMEAGPYPERIGEPDCSYYMRTGLCRFGMTCKFNHPADRKMAVAAARMKGEYPQRIGQPECQYYLKTGTCKFGATCKFHHPREKAAIATRVQLNALGYPLRPNEKECAYYLRTGQCKFGSTWAVTNWPLSRSASFIASPRWPGHSSYAQVIVPPGLVQVPGWNPYAAQIGSSSSDDQQRTAGGAQYYTGSRHSETPNMGDQGMFSSYQAGSVPLGLYTVQRESIFPERPDQPECQFYMKTGDCKFGAVCKFHHPKERIIPTPNCALSSLGLPLRPGEPICTFYSRYGICKFGPNCKFDHPMGTVMYGLATSPTGDVSARRMLAPVPAHSEVSPDNVSGRSRRITHSDSQQIPSGERGTEREAS

SEQ ID NO: 8143 - protein, 428 aa, Medicago truncatula
  misc_feature (1)..(428): Public GI ID NO.124359159
  misc_feature (1)..(428): Functional Homolog of  Ceres CLONE NO.149496
  misc_feature (1)..(428): useful for making plants with altered flowering time as described in USSN 12/281,616
MEYDAIPQEAMWQMSLRPSETMESGPYPEHPGEPDCSYYIRTGLCRFGATCRFNHPPNRKLAIATARMKGEFPERLGQPECQASVNECCIMHYYLKTGTCKFGATCRFHHPKDKAGVAGRVALNILGYPLRPNESECAYYLRTGQCKFGNTCKFHHPQPSNMVLPMRGSPVYPTVQSPTTAGQQSYAAGITNWSTSSYIPSPRWQGPSSYAPLILPQGVVSVPGWSTYNGQMGSDSPQQTMRNDQTYGTSHQGDPENAGLQGVYSQYRSGSVPVGFYALQRENIFPERPDQPECQFYMKTGDCKFGAVCRFHHPRERTIPAPDCVLSPLGLPLRPGEPLCVFYSRYGICKFGPSCKFDHPMGIFTYNVSASPLAEAAGRRLLGSSSGTAALSLSSEGLVESGSVKPRRLSLSETRPNPSGDDDIDDEG

SEQ ID NO: 8144 - DNA, 1230 bp, Populus balsamifera subsp. trichocarpa
  misc_feature (1)..(1230): Ceres ANNOT ID no.1525459
  misc_feature (1)..(1230): useful for making plants with altered flowering time as described in USSN 12/281,616
atgccagaccacaacaacaggcaggttaagagcaatgctgtgtcaaatcaatccgctgaaaacattgaagaagcaatttggcgattgaaaatacatgatcatcaagagcaagggggtatggctcaatcaagtccatacccagatcgtcctggtgcaccagattgtggatattatttaaggactggattatgtggttatggaagcaattgtcgctttaatcatcctgtttatgctgcactgggcgcgcaattgagagaagaacttccagagagagttggacagcctgactgtgggtattatttgaagacagggacttgcaaatatggatctacttgtaaatatcatcatccaagagacaggaatggtgcaggaccagtttcatttaacgcgttgggtcttcctatgcgtcaggatgaaaaatcatgtccttactacatgcggaccagatcatgtaaatttggagttgcatgcaaattccaccacccccagcctgcgtcattgggaactagcttctccctaactggagctgctgcctttggatctacgggatcaccaattgtgccatcttcaggcctgccttatgtaggtggacttccaacatggtcgttaccaagggcaccacttatgtctggcacaaatttacaaggtccacaagcttatatgcctgttgttgtatctccttctccaggcatcattcctgtcccaggctggaacacctatgtgatcagccctattctccctgagagacctggtcaaccagaatgccggcattttatgagcactgggacctgcaaatatggttctgactgcaagtaccatcacccaaaagaaaggattgcacagctagcaaccaatactatgggcctgcttggacttccctcgagacctgggcaagccgtgtgtccagactacagtatgtatggaatctgcaagttcggcccaacctgcagatatgatcaccccatacatacatatccttataactatagcttgagcctgccatctttatctataatggattcatctctgataacttatccaagaatggcacaagcagctcctgttaccttgtcgaaactccctgatttgatccacaatcctgatggtgcaagctacaataagcatcagaatcctgatacaagtacaaagatttcagatgatccaaccgagcaagctggttccccaccaccacactcttcacaggcttcttcagaaccttcacacgattaa

SEQ ID NO: 8145 - protein, 409 aa, Populus balsamifera subsp. trichocarpa
  misc_feature (1)..(409): Ceres ANNOT ID NO.1525459
  misc_feature (250)..(276): Pfam Name: zf-CCCH Pfam Description: Zinc finger C-x8-C-x5-C-x3-H type (and similar)
  misc_feature (1)..(409): Functional Homolog of  Ceres CLONE NO.149496 with e-value of 1.39E-85 and BLAST sequence identity of 52.4
  misc_feature (1)..(409): useful for making plants with altered flowering time as described in USSN 12/281,616
MPDHNNRQVKSNAVSNQSAENIEEAIWRLKIHDHQEQGGMAQSSPYPDRPGAPDCGYYLRTGLCGYGSNCRFNHPVYAALGAQLREELPERVGQPDCGYYLKTGTCKYGSTCKYHHPRDRNGAGPVSFNALGLPMRQDEKSCPYYMRTRSCKFGVACKFHHPQPASLGTSFSLTGAAAFGSTGSPIVPSSGLPYVGGLPTWSLPRAPLMSGTNLQGPQAYMPVVVSPSPGIIPVPGWNTYVISPILPERPGQPECRHFMSTGTCKYGSDCKYHHPKERIAQLATNTMGLLGLPSRPGQAVCPDYSMYGICKFGPTCRYDHPIHTYPYNYSLSLPSLSIMDSSLITYPRMAQAAPVTLSKLPDLIHNPDGASYNKHQNPDTSTKISDDPTEQAGSPPPHSSQASSEPSHD

SEQ ID NO: 8146 - DNA, 1597 bp, Zea mays
  misc_feature (1)..(1597): Ceres CLONE ID no.367249
  misc_feature (1)..(1597): useful for making plants with altered flowering time as described in USSN 12/281,616
gttcctctcattccccttccacctctctctttctttccactactcgccctctctctcttgcgcgcgcgtgacaacatccctccacgggcgcgcggcgcgggagcacccaccgacttatcgccggtggggcggggcgggggcgatctgatgccggcgcggcggtgatggcagcgccgtccggcggtgggggcggcggtgcgggggagggctcctcctcggccgccgcagctatgacgatcggggcctacggggtggaccaagtcacagaagcgatgtggcagatgaatttaggagatgccatggaactggggccatacccagagcgtgttggtgatccagactgtagctattacatgaggactggcatgtgcaggtttgggatgacctgtaaatttaatcacccagcagacagaaagctggctgttgctgctgcaagaatgaagggagaatatcctcaaagaattggacagcctgaatgtcaatactatctgaagactggcacatgcaagtttggagcaacttgcaagtttcatcatccccgagaaaaggctgcaatggcaactcgagttcagctgaatgaactgggctacccactccgcctgaatgaaaaggaatgtgcttattatttaagaacagggcagtgcaagtttggaagcacatgtaagtttcaccatccacaaccatccactatgatggttgccgtacgtggctctgtttattcacctggacagtctgcaatttctcctggccatcatgcttactagggggctgtaacaagctggcccttgtcgagatctgcttctttcattgcaagtccaaggtggccaggtcattcaagttatgcacaagttattgttcctcctgggcttgttcaggtcccagggtggagtccttatgctgcgcagattggttcttcatcctcggatgaccaacaacggacacctggagctgcccaatactatactggctcacgccagagtggaacacctggcataggcgatcgaggaatgttttcatcctaccaagcaggttctcttcccgttggactttatgcagtacagacggagaatgtatttccagagagacctgaccaacctgaatgtcagttctatatgaagaccggagactgtaagtttggttctgtatgcaagttccatcatcccagggagcgaataattcctactcccaattgtgcactaagtccattaggcctacctttgcgcccgggagaaccaatatgcagtttctataatcgctatggcatgtgcaagtttggtccaaattgcaaatttcatcatccgatgggaaaccctatgtatggccatgcttcatcaccgacaagtgaggcccaaacatctcggcgtatgctggcacatgtaccatcgcatccagaagtatcacctgacagtggctcgggaaggtctaggaggattgttcattcagattcccagcaaataccctctgttgaaaggatcaccgagagagaggcgtcctaagccatcctcggtgtcttcgttcatgctgcctcccctcccctcccctcccattcttgacgagtaattaaatgcaacaacatctgaaaaaaaaaaaaaaaaaa

SEQ ID NO: 8147 - protein, 443 aa, Zea mays
  misc_feature (1)..(443): Ceres CLONE ID NO.367249
  misc_feature (308)..(334): Pfam Name: zf-CCCH Pfam Description: Zinc finger C-x8-C-x5-C-x3-H type (and similar)
  misc_feature (1)..(443): Functional Homolog of  Ceres CLONE NO.149496
  misc_feature (1)..(443): useful for making plants with altered flowering time as described in USSN 12/281,616
MAAPSGGGGGGAGEGSSSAAAAMTIGAHGVDQVTEAMWQMNLGDAMELGPYPERVGDPDCSYYMRTGMCRFGMTCKFNHPADRKLAVAAARMKGEYPQRIGQPECQYYLKTGTCKFGATCKFHHPREKAAMATRVQLNELGYPLRLNEKECAYYLRTGQCKFGSTCKFHHPQPSTMMVAVRGSVYSPGQSATSPGHHAYQGAVTSWPLSRSASFIASPRWPGHSSYAQVIVPPGLVQVPGWSPYAAQIGSSSSDDQQRTPGAAQYYTGSRQSGTPGIGDRGMFSSYQAGSVPVGLYAVQTENVFPERPDQPECQFYMKTGDCKFGSVCKFHHPRERIIPTPNCALSPLGLPLRPGEPICSFYNRYGMCKFGPNCKFHHPMGNPMYGHASSPTSEAQTSRRMLAHVPSHPEVSPDSGSGRSRRIVHSDSQQIPSVERITEREAS

SEQ ID NO: 8148 - DNA, 2020 bp, Zea mays
  misc_feature (1)..(2020): Ceres CLONE ID no.1579587
  misc_feature (1)..(2020): useful for making plants with altered flowering time as described in USSN 12/281,616
aggttcctctcattccccttccacctctctctttctttccactactcgccctctctctcttgcgcgcgcgtgacaacatccctccacgggcgcgcggcgcgggagcacccaccgacttatcgccggtggggcggggcgggggcgatctgatgccggcgcggcggtgatggcagcgccgtccggcggtgggggcggcggtgcgggggagggctcctcctcggccgccgcagctatgacgatcggggcccacggggtggaccaagtcacagaagcgatgtggcagatgaatttaggagatgccatggaactggggccatacccagagcgtgttggtgatccagactgtagctattacatgaggactggcatgtgcaggtttgggatgacctgtaaatttaatcacccagcagacagaaagctggctgttgctgctgcaagaatgaagggagaatatcctcaaagaattggacagcctgaatgtcaatactatctgaagactggcacatgcaagtttggagcaacttgcaagtttcatcatccccgagaaaaggctgcaatggcaactcgagttcagctgaatgaactgggctacccactccgcctgaatgaaaaggaatgtgcttattatttaagaacagggcagtgcaagtttggaagcacatgtaagtttcaccatccacaaccatccactatgatggttgccgtacgtggctctgtttattcacctggacagtctgcaacttctcctggccatcatgcttaccagggggctgtaacaagctggcccttgtcgagatctgcttctttcattgcaagtccaaggtggccaggtcattcaagttatgcacaagttattgttcctcctgggcttgttcaggtcccagggtggagtccttatgctgcgcagattggttcttcatcctcggatgaccaacaacggacacctggagctgcccaatactatactggctcacgccagagtggaacacctggcataggcgatcgaggaatgttttcatcctaccaagcaggttctgttcccgttggactttatgcagtacagacggagaatgtatttccagagagacctgaccaacctgaatgtcagttctatatgaagaccggagactgtaagtttggttctgtatgcaagttccatcatcccagggagcgaataattcctactcccaattgtgcactaagtccattaggcctacctttgcgcccgggagaaccaatatgcagtttctataatcgctatggcatgtgcaagtttggtccaaattgcaaatttcatcatccgatgggaaaccctatgtatggccatgcttcatcaccgacaagtgaggcccaaacatctcggcgtatgctggcacatgtaccatcgcatccagaagtatcacctgacagtggctcgggaaggtctaggaggattgttcattcagattcccagcaaataccctctgttgaaaggatcaccgagagagaggcgtcctaagccatcctcggtgtcttcgttcatgctgcctcccctcccctcccctcccattcttgacgagtaattaaatgcaacaacatctgagaatccgaagctgtacaggtcttttgcctcatctttgagctttacataccggagcttgcttcaacatgtattgcatccaggcatgaaaaagttcttgccggttcgggatgctcatttgcccccataaaaacgggaacaaacctaccttatttaaacatatgtatgaaactcactcacctctggacattcaaacccattcgagtaatggtcccggtgttgtagtttatagagctgtgtttcagtggacaaacctttgcgaaactgactggggatgcgcaagcatagcctcctttattaattattatctcgtttttttcctagcatctctcttttcataagggcaacccaaagtgttggaataatagattgccaccataatgctctgtattacccaccatatttaaacctggttacttgtgagcaaaaaaaaaaaaaaaa

SEQ ID NO: 8149 - protein, 443 aa, Zea mays; identical to SEQ ID NO: 8147
  misc_feature (1)..(443): Ceres CLONE ID NO.1579587
  misc_feature (308)..(334): Pfam Name: zf-CCCH Pfam Description: Zinc finger C-x8-C-x5-C-x3-H type (and similar)
  misc_feature (1)..(443): Functional Homolog of  Ceres CLONE NO.149496 with e-value of 4.19E-68 and BLAST sequence identity of 43.6
  misc_feature (1)..(443): useful for making plants with altered flowering time as described in USSN 12/281,616

SEQ ID NO: 8150 - protein, 454 aa, Oryza sativa subsp. japonica
  misc_feature (1)..(454): Public GI ID NO.77554746
  misc_feature (319)..(345): Pfam Name: zf-CCCH Pfam Description: Zinc finger C-x8-C-x5-C-x3-H type (and similar)
  misc_feature (1)..(454): Functional Homolog of  Ceres CLONE NO.149496 BLAST sequence identity of 46.1
  misc_feature (1)..(454): useful for making plants with altered flowering time as described in USSN 12/281,616
MAAGAGAGGGGGEGDSNGGGTSPGGVSAAAPAIGPHHLGVAAAEEAMWQMTLGGGESMESTPYPERIGEPDCSYYMRTGLCRFGMTCKFNHPPNRKLAVAAARMNGEYPYRVGQPECQYYLKTGTCKFGATCKFHHPREKAALANRVQLNVLGYPMRPNEKECAYYLRTGQCKFASTCKFHHPQPSNTMVAVRNSMYSPGQSATSPGQHTYPGAVTNWTLSRSASFIASPRWPGHSGYAQVIVPQGLVQVPGWNPYAAQMGSSSPDDQQRTPVTTQYYGSRQSETGGMGDHGMYQSYQGGSVPVGVYTVQGENIFPERPDQPECQFYMKTGDCKFGAVCKFHHPKERLVPAPNCALNSLGLPLRPGEPVCTFYSRYGICKFGPNCKFDHPMGTLMYGSATSPRGDVSSMHYQLSPSPGHPGILLDGGSGRSHRVPQSDSQQIPSGDGNAEREAS

SEQ ID NO: 8151 - DNA, 1558 bp, Arabidopsis thaliana
  misc_feature (1)..(1558): Ceres CLONE ID no.21240
  misc_feature (1)..(1558): useful for making plants with altered flowering time as described in USSN 12/281,616
aaaaccaaaacgatggcgtttcatcacaatcatctctcacaagacctctccttcaatcatttcaccgaccaacaccaacctccacctccgcaaccgcctcctcctcctccgcaacagcaacaacatttccaagaagcaccgcctcctaattggttaaacacagcgcttcttcgttcctcagataacaacaataacttcctcaacctccacacagccaccgctaacaccacaaccgcaagcagctccgattctccttcctccgccgccgccgccgccgctgctaaccagtggctatctctctcctcctctttcctccaacgaaacaacaacaacaacgcttccatagtcggagatgggatcgatgatgtcaccggaggagcagacactatgattcagggagagatgaaaaccggcggtggagaaaacaaaaacgacggcggaggagctacggcggcggatggagtagtgagctggcagaatgcgagacacaaggcggagatcctttcgcatcctctttacgagcagcttttgtcggcgcacgttgcttgtttgagaatcgcgactccggttgatcagcttccgagaatcgatgctcagcttgctcagtctcaacacgtcgtcgctaaatactcagctttaggcgccgccgctcaaggtctcgtcggcgacgataaagaacttgaccagttcatgacacattatgtgttgctactgtgttcatttaaagagcaattgcaacaacatgtgcgtgttcatgcaatggaagctgtgatggcttgttgggagattgagcagtctcttcaaagcttaacaggagtgtctcctggagaagggatgggagcaacaatgtctgacgatgaagatgaacaagtagagagtgatgctaatatgttcgatgggggattagatgtgttgggttttggtcctttgattcctactgagagtgagaggtcgttgatggaaagagttagacaagaacttaaacatgaactcaaacagggttacaaggagaagatagtagacataagagaggagatattaaggaagagaagagctgggaagttaccaggagataccacctctgttctcaaagcttggtggcaatctcattccaaatggccttaccctactgaggaagataaggcgaggttggtgcaagagacaggtttgcagctaaaacagataaacaattggttcatcaatcagagaaagaggaactggcatagcaatccatcttcttccactgtattgaagaacaaacgcaaaagcaatgcaggtgacaatagcggaagagagcggttcgcgtagaaacaacaaacatatgatgtgaattggggaggtggaagatgggatttgaaagcagggttttagggatttaaagttgagaattttatggaggagtttggattatacagagagaggggacagtattagaaagtaactttttgtgcaattacatagtaacgtagtttggttatgtgattatgcccatatattttattaagtagcacacaaaccaaaaagaaaatatgaaaactgaagatgcaggcttttgttc

SEQ ID NO: 8152 - protein, 431 aa, Arabidopsis thaliana
  misc_feature (1)..(431): Ceres CLONE ID NO.21240
  misc_feature (157)..(201): Pfam Name: KNOX1 Pfam Description: KNOX1 domain
  misc_feature (213)..(268): Pfam Name: KNOX2 Pfam Description: KNOX2 domain
  misc_feature (322)..(343): Pfam Name: ELK Pfam Description: ELK domain
  misc_feature (1)..(431): useful for making plants with altered flowering time as described in USSN 12/281,616
MAFHHNHLSQDLSFNHFTDQHQPPPPQPPPPPPQQQQHFQEAPPPNWLNTALLRSSDNNNNFLNLHTATANTTTASSSDSPSSAAAAAAANQWLSLSSSFLQRNNNNNASIVGDGIDDVTGGADTMIQGEMKTGGGENKNDGGGATAADGVVSWQNARHKAEILSHPLYEQLLSAHVACLRIATPVDQLPRIDAQLAQSQHVVAKYSALGAAAQGLVGDDKELDQFMTHYVLLLCSFKEQLQQHVRVHAMEAVMACWEIEQSLQSLTGVSPGEGMGATMSDDEDEQVESDANMFDGGLDVLGFGPLIPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSSSTVLKNKRKSNAGDNSGRERFA

SEQ ID NO: 8153 - DNA, 1446 bp, Populus balsamifera subsp. trichocarpa
  misc_feature (1)..(1446): Ceres ANNOT ID no.1508832
  misc_feature (1)..(1446): useful for making plants with altered flowering time as described in USSN 12/281,616
atggcctttcaccataacttgccatcacaagaccttcctcttcaccacttcacagaccaacaagcaacagaaaacaccacagcaccaccgaattggctgaacactgctctcctccgctctcaacaaccaccacaacaacgaactcaccaccacttcactgataacaacaacaccaacaatttcttaaacctccatagcgctaccccttccaccaccgccaccacttctgactccgcttctcataatccaactcaatggctctcccgttcctcctcctccctacttaaccgcaaccacagtaccgtcatcgacgacgtctccgccgctgccgccggtggagaccaccccatcatcgctagtatgtcgcaagaatcgtcagaattgaagagcatgaataagagcgaaggagaaaccatggtggagagtggcggtggtggaggagaggcggtggtgaattggcaaaatgcgaagtgtaaagcggacatattggcgcatcctttgtatgatcaattgttgtctgcccacgtggcgtgtttaaggattgccacgcctgttgatcagttgccgaggattgatgcccaattggctcagtcacaacaagtagtggctaaatactctgctcttggaagtcatcaaggattggttcctgatgacaaagagcttgatcagtttatgacacattactttctgttactttgttccttcaaagaacaattgcaacaacatgttcgagttcatgcaatggaagcggtgatggcttgctgggagatagagcaatccctacaaagtttaacaggagtttctccaggtgaaggtactggtgcaacaatgtccgatgatgatgaagaccaagttgacagtgaggccaatatgtttgatggaagtttggagggtgtagatacaatggggtttggtcccttggtccctacagagagtgagagatctttgatggagcgtgtgaggcaggaattgaagcatgaattaaaacagggttacaaggagaaaattgttgacattagagaggaaattttgcgcaagagaagagcgggaaagcttcctggtgacacaacctcagtcttaaaagcttggtggcaatcacattccaagtggccatatcctaccgaggaagacaaggcgagattggtacaggaaacaggtttgcaattaaagcagataaataattggttcatcaatcaaaggaagaggaactggcacagtaatccttcaacttcaacagtcttaaaaagcaaacgcaaaaggtattttattgttttattaaagcatgtattctcatctaatttaatacctgatgagcttcgaactaactttaatttgaaaagaagtaatgcagcttgcactccagcaagtacattgaacatactacatagcaatggaactgcaaagggtttgacagtggtctacagaattcgagtaagagaaccatag

SEQ ID NO: 8154 - protein, 481 aa, Populus balsamifera subsp. trichocarpa
  misc_feature (1)..(481): Ceres ANNOT ID NO.1508832
  misc_feature (156)..(200): Pfam Name: KNOX1 Pfam Description: KNOX1 domain
  misc_feature (211)..(266): Pfam Name: KNOX2 Pfam Description: KNOX2 domain
  misc_feature (323)..(344): Pfam Name: ELK Pfam Description: ELK domain
  misc_feature (1)..(481): Functional Homolog of  Ceres CLONE NO.21240 with e-value of 7.39E-149 and BLAST sequence identity of 79.1
  misc_feature (1)..(481): useful for making plants with altered flowering time as described in USSN 12/281,616
MAFHHNLPSQDLPLHHFTDQQATENTTAPPNWLNTALLRSQQPPQQRTHHHFTDNNNTNNFLNLHSATPSTTATTSDSASHNPTQWLSRSSSSLLNRNHSTVIDDVSAAAAGGDHPIIASMSQESSELKSMNKSEGETMVESGGGGGEAVVNWQNAKCKADILAHPLYDQLLSAHVACLRIATPVDQLPRIDAQLAQSQQVVAKYSALGSHQGLVPDDKELDQFMTHYFLLLCSFKEQLQQHVRVHAMEAVMACWEIEQSLQSLTGVSPGEGTGATMSDDDEDQVDSEANMFDGSLEGVDTMGFGPLVPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSTSTVLKSKRKRYFIVLLKHVFSSNLIPDELRTNFNLKRSNAACTPASTLNILHSNGTAKGLTVVYRIRVREP

SEQ ID NO: 8155 - protein, 393 aa, Arabidopsis thaliana
  misc_feature (1)..(393): Public GI ID NO.1045044
  misc_feature (121)..(165): Pfam Name: KNOX1 Pfam Description: KNOX1 domain
  misc_feature (177)..(232): Pfam Name: KNOX2 Pfam Description: KNOX2 domain
  misc_feature (286)..(307): Pfam Name: ELK Pfam Description: ELK domain
  misc_feature (1)..(393): Functional Homolog of  Ceres CLONE NO.21240 with e-value of 4.90E-168 and BLAST sequence identity of 87.9
  misc_feature (1)..(393): useful for making plants with altered flowering time as described in USSN 12/281,616
MAFHNNHFNHFTDQQQHQPPPPPQQQQQQHFQESAPPNWLLRSDNNFLNLHTAATAAATSSDSPSSAAANQWLSRSSSFLQRGNTANNNNNETSGDVIEDVPGGEESMIGEKKEAERWQNARHKAEILSHPLYEQLLSAHVACLRIATPVDQLPRIDAQLAQSQNVVAKYSTLEAAQGLLAGDDKELDHFMTHYVLLLCSFKEQLQQHVRVHAMEAVMACWEIEQSLQSFTGVSPGEGTGATMSEDEDEQVESDAHLFDGSLDGLGFGPLVPTESERSLMERVRQELKHELKQGYKEKIVDIREEILRKRRAGKLPGDTTSVLKSWWQSHSKWPYPTEEDKARLVQETGLQLKQINNWFINQRKRNWHSNPSSSTVSKNKRRSNAGENSGRDR

SEQ ID NO: 8156 - protein, 375 aa, Oryza sativa subsp. japonica
  misc_feature (1)..(375): Public GI ID NO.1805617
  misc_feature (106)..(150): Pfam Name: KNOX1 Pfam Description: KNOX1 domain
  misc_feature (159)..(215): Pfam Name: KNOX2 Pfam Description: KNOX2 domain
  misc_feature (270)..(291): Pfam Name: ELK Pfam Description: ELK domain
  misc_feature (1)..(375): Functional Homolog of  Ceres CLONE NO.21240 with e-value of 1.30E-121 and BLAST sequence identity of 72.4
  misc_feature (1)..(375): useful for making plants with altered flowering time as described in USSN 12/281,616
MAFHGHLPHEMTMQALGADDAAVAAAAAAGGVGAGGAPAWMRYNDGSFLHLQTTSDSSASPSGAAAAAAAAAAAAAAGVQQWMGGGGGGEDAVAAAMGGGGEADAARCKAEILAHPLYEQLLSAHVACLRIATPVDQLPRIDAQLAQSQGVVAKYSALAAAAAGDDGRELDQFMTHYVLLLCSFKEQLQQHVRVHAMEAVMACWELEQNLQSLTGASPGEGTGATMSDGEDDQADSEANMYDPSLDGADNMGFGLPTESERSLMERVRQELKHELKQGYKEKLIDIREEILRKRRAGKLPGDTTSTLKAWWQSHAKWPYPTEEDKARLVQETGLQLKQINNWFINQRKRNWHSNPSSSTSVKTKRKRAGGIHPKQ

SEQ ID NO: 8157 - protein, 427 aa, Malus x domestica
  misc_feature (1)..(427): Public GI ID NO.1946222
  misc_feature (165)..(209): Pfam Name: KNOX1 Pfam Description: KNOX1 domain
  misc_feature (218)..(273): Pfam Name: KNOX2 Pfam Description: KNOX2 domain
  misc_feature (330)..(351): Pfam Name: ELK Pfam Description: ELK domain
  misc_feature (1)..(427): Functional Homolog of  Ceres CLONE NO.21240 and BLAST sequence identity of 75.7
  misc_feature (1)..(427): useful for making plants with altered flowering time as described in USSN 12/281,616
MAYHNHLSQDLPLHHFTDQTHHQHQQYQSDQPDPNSKPPEPHHSFQPAPNWLNSALLRNFTNTDTNPTNSNNANNNGGGVSNFLNLHVTASDSAASQASNQWLSQSHRPILHRNHSDVNDDVTVAGDSMIAAALSHDSADLKPDSILNKNEGGGGDGGVMNWQNARHKAEILAHPLYEPLLSAHVACLRIATPVDQLPRIDAQLAQSQNVVAKYSALGNGMVGDDKELDQFMRNYVLLLCSFKEQLQQHVRVHAMEAVMACWEIEQSLQSLTGVSPGEGTSATMSDDEDDQVDSDANLFDEGMEGHDSMGFGPLIPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSTSTVLKSKRKR

SEQ ID NO: 8158 - protein, 393 aa, Arabidopsis thaliana
  misc_feature (1)..(393): Public GI ID NO.26451634
  misc_feature (121)..(165): Pfam Name: KNOX1 Pfam Description: KNOX1 domain
  misc_feature (177)..(232): Pfam Name: KNOX2 Pfam Description: KNOX2 domain
  misc_feature (286)..(307): Pfam Name: ELK Pfam Description: ELK domain
  misc_feature (1)..(393): Functional Homolog of  Ceres CLONE NO.21240 and BLAST sequence identity of 87.7
  misc_feature (1)..(393): useful for making plants with altered flowering time as described in USSN 12/281,616
MAFHNNHFNHFTDQQQHQPPPPPQQQQQQHFQESAPPNWLLRSDNNFLNLHTAASAAATSSDSPSSAAANQWLSRSSSFLQRGNTANNNNNETSGDVIEDVPGGEESMIGEKKEAERWQNARHKAEILSHPLYEQLLSAHVACLRIATPVDQLPRIDAQLAQSQNVVAKYSTLEAAQGLLAGDDKELDHFMTHYVLLLCSFKEQLQQHVRVHAMEAVMACWEIEQSLQSFTGVSPGEGTGATMSEDEDEQVESDAHLFDGSLDGLGFGPLVPTESERSLMERVRQELKHELKQGYKEKIVDIREEILRKRRAGKLPGDTTSVLKSWWQSHSKWPYPTEEDKARLVQETGLQLKQINNWFINQRKRNWHSNPSSSTVSKNKRRSNAGENSGRDR

SEQ ID NO: 8159 - DNA, 1359 bp, Populus balsamifera subsp. trichocarpa
  misc_feature (1)..(1359): Ceres ANNOT ID no.1531214
  misc_feature (1)..(1359): useful for making plants with altered flowering time as described in USSN 12/281,616
atggcctatcaccataacttgtcatcacaagacctccctcttcaccacttcacagaccaacaagcaacagagaaccacacagcaccaccgaattggctgaacactgccctcctccgctctcaacaaccaccacagcaacaaactcaccaccacttcactgataacaacaacacaaacaatttcttaaacctccacaccgccaccactaccgccaccgccaccacttctgactcaaactctcataacccagttcaatggctctcccggtcctcctcctccctcctaaaccgcaaccacagtgacgtcatcgacgacgtcgccgccggcggggaccacgccatcataactagtatatcgcaagaatcgtcggaattgaagaatatgaataagggtgaaggtgaagccatggatagtggtggaggagagtcggtggtgaattggcaaaatgcaaggtataaagcggacatattgacgcatccgttgtacgatcaattgctgtcggcacacgtggcgtgtttaaggattgccacgccagttgatcagttgccgaggattgatgcacagttggctcagtcacagcaagtagtaactaagtactctgctcttggaagtcaccaaggattggttcctgatgataaagagcttgatcagtttatgacacattattttcttttgctctgttccttcaaagaacaattgcaacaacatgttcgagttcatgcaatggaagcagtgatggcgtgctgggagatagagcaatccctacagagtttaacgggagtttctccaggtgaaggtacaggcgcaacaatgtccgatgacgatgaagaccaagttgacagtgatgccaatttgttcgttggaagtttggagggtgcagatacactggggtttggtcccttggtccctacagagagtgagagatctttgatggagcgtgtgagacaagaattgaagcatgaattaaaacagggttacaaagaaaaaattgttgacattagagaggaaattctgcgaaagagaagagcaggaaagcttcctggggacacaacctcagtcttaaaagcttggtggcaatcacattccaagtggccatatcctaccgaggaagacaaggcaagattggtgcaggaaacgggcttgcaattaaagcagataaataattggttcatcaatcaaaggaagaggaactggcacagtaatccttcaacctcaacagtcttgaaaagcaaacgcaaaagaaaaactctactgagcctgggcaaggaaaaacaaaccctatcgatcaatgcagaagttgaagcaaccagcccccttgaagagggttggtacgcaggagtgactgattccagtcattga

SEQ ID NO: 8160 - protein, 452 aa, Populus balsamifera subsp. trichocarpa
  misc_feature (1)..(452): Ceres ANNOT ID NO.1531214
  misc_feature (150)..(194): Pfam Name: KNOX1 Pfam Description: KNOX1 domain
  misc_feature (205)..(260): Pfam Name: KNOX2 Pfam Description: KNOX2 domain
  misc_feature (317)..(338): Pfam Name: ELK Pfam Description: ELK domain
  misc_feature (1)..(452): Functional Homolog of  Ceres CLONE NO.21240 with e-value of 6.50E-150 and BLAST sequence identity of 80.3
  misc_feature (1)..(452): useful for making plants with altered flowering time as described in USSN 12/281,616
MAYHHNLSSQDLPLHHFTDQQATENHTAPPNWLNTALLRSQQPPQQQTHHHFTDNNNTNNFLNLHTATTTATATTSDSNSHNPVQWLSRSSSSLLNRNHSDVIDDVAAGGDHAIITSISQESSELKNMNKGEGEAMDSGGGESVVNWQNARYKADILTHPLYDQLLSAHVACLRIATPVDQLPRIDAQLAQSQQVVTKYSALGSHQGLVPDDKELDQFMTHYFLLLCSFKEQLQQHVRVHAMEAVMACWEIEQSLQSLTGVSPGEGTGATMSDDDEDQVDSDANLFVGSLEGADTLGFGPLVPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSTSTVLKSKRKRKTLLSLGKEKQTLSINAEVEATSPLEEGWYAGVTDSSH

SEQ ID NO: 8161 - DNA, 1510 bp, Glycine max
  misc_feature (1)..(1510): Ceres CLONE ID no.515966
  misc_feature (1)..(1510): useful for making plants with altered flowering time as described in USSN 12/281,616
gaacaacaaacaaacaaacaccaccaacaacaaccactcctcttctttttcaccctcgaatccacgcttcctttacaccgcgtttggatctccgttaaacaaaaccattaaaatgtagcgagagaaaaacaaaaccgcaaaagaaaatcagttaatttattaattttatttttttatggctttccacgaccatctccagcacgaaatagcgttccagcgtttcacggaggagcaagagttgaccgagaacagagacatgcagcagaggctcccacctccgacatggctcaacaacgttaacgcgcgtcaacagaatttcctcgacaccgagaagagcgtggatcggaacaaccgaagcgagagcaattgcgaatccgaggatttgagggaatacaaagcggacattctaggtcaccctctctacgatcaactgttgtcggcgcacgtctcgtgcctcagaatcgccacgccggtggaccagcttcctaggatcgatgcgcagcttcagcagtcgcagcgcgtggttgaaaagtactctgcacttgcacacaacggggtcgtcgatgagaaggagcttgatcagttcatgacccattatgttctgttgctctgtgcctttaaagaacaactgcagcagcatgtccgtgttcatgccatggaggcagtgatggcttgttgggatctggagcaatctctgcaaagcttgacaggtgtatctcctggtgaaggaacgggtgcaacaatgtcagacgatgaagatgaccaggcagagagcaatgccaacttatacgaaggaagccttgatggcggcgaaactcttggatttggtcctcttgtccccactgaaagtgaaagatctttgatggaaagagtcaggcatgagttgaagcatgaactaaaacagggttacaaggagaagattgtggacataagagaagaaattctaagaaagagacgagcggggaagcttccaggggacaccacatcccttttgaaagcttggtggcaatcacattctaaatggccttaccccactgaggaagacaaggctagattggtgcaggaaacagggttgcaattaaagcagataaataattggttcataaatcaaaggaaaaggaacytggcatacaaataacccctcatcctctagcaactccaaaagcaaagcgcaagagtagtgcaggagaagccagtaaccagagcttcatgtgaacggtcgcatattttgaacaaaaattattggtattgttctcccttttaatgcatgctcgtgggattcatagatcttacggtccagcgtgaacgtgatggattctggatgaaaaagggaaattcatgatatataaaaccactgtattggttgaattacagaaaattatccctggtattgttgtatatgaggctgctgcatgccgcttgatatctgatattgatgcagtcgcattctattcgatttaatgggtagcatgctgatattattctgcttatttaaaaatattatggatcc

SEQ ID NO: 8162 - protein, 345 aa, Glycine max
  misc_feature (1)..(345): Ceres CLONE ID NO.515966
  misc_feature (124)..(179): Pfam Name: KNOX2 Pfam Description: KNOX2 domain
  misc_feature (236)..(257): Pfam Name: ELK Pfam Description: ELK domain
  misc_feature (71)..(115): Pfam Name: KNOX1 Pfam Description: KNOX1 domain
  misc_feature (1)..(345): Functional Homolog of  Ceres CLONE NO.21240 with e-value of 6.10E-125 and BLAST sequence identity of 86.0
  misc_feature (1)..(345): useful for making plants with altered flowering time as described in USSN 12/281,616
MAFHDHLQHEIAFQRFTEEQELTENRDMQQRLPPPTWLNNVNARQQNFLDTEKSVDRNNRSESNCESEDLREYKADILGHPLYDQLLSAHVSCLRIATPVDQLPRIDAQLQQSQRVVEKYSALAHNGVVDEKELDQFMTHYVLLLCAFKEQLQQHVRVHAMEAVMACWDLEQSLQSLTGVSPGEGTGATMSDDEDDQAESNANLYEGSLDGGETLGFGPLVPTESERSLMERVRHELKHELKQGYKEKIVDIREEILRKRRAGKLPGDTTSLLKAWWQSHSKWPYPTEEDKARLVQETGLQLKQINNWFINQRKRNWHTNNPSSSSNSKSKRKSSAGEASNQSFM

SEQ ID NO: 8163 - protein, 374 aa, Oryza sativa subsp. japonica
  misc_feature (1)..(374): Public GI ID NO.1805618
  misc_feature (106)..(150): Pfam Name: KNOX1 Pfam Description: KNOX1 domain
  misc_feature (159)..(215): Pfam Name: KNOX2 Pfam Description: KNOX2 domain
  misc_feature (270)..(291): Pfam Name: ELK Pfam Description: ELK domain
  misc_feature (1)..(374): Functional Homolog of  Ceres CLONE NO.21240 with e-value of 8.40E-125 and BLAST sequence identity of 73.2
  misc_feature (1)..(374): useful for making plants with altered flowering time as described in USSN 12/281,616
MAFHGHLPHEMTMQALGADDAAVAAAAAAGGVGAGGAPAWMRYNDGSFLHLQTTSDSSASPSGAAAAAAAAAAAAAAGVQQWMGGGGGGEDAVAAAMGGGGEADAARCKAEILAHPLYEQLLSAHVACLRIATPVDQLPRIDAQLAQSQGVVAKYSALAAAAAGDDGRELDQFMTHYVLLLCSFKEQLQQHVRVHAMEAVMACWELEQNLQSLTGASPGEGTGATMSDGEDDQADSEANMYDPSLDGADNMGFGLPTESERSLMERVRQELKHELKQGYKEKLIDIREEILRKRRAGKLPGDTTSTLKAWWQSHAKWPYPTEEDKARLVQETGLQLKQINNWFINQRKRNWHSNPSSSTSVKTKRKSNAGDNNS

SEQ ID NO: 8164 - protein, 426 aa, Lycopersicon esculentum
  misc_feature (1)..(426): Public GI ID NO.6016226
  misc_feature (161)..(205): Pfam Name: KNOX1 Pfam Description: KNOX1 domain
  misc_feature (215)..(270): Pfam Name: KNOX2 Pfam Description: KNOX2 domain
  misc_feature (327)..(348): Pfam Name: ELK Pfam Description: ELK domain
  misc_feature (1)..(426): Functional Homolog of  Ceres CLONE NO.21240 with e-value of 1.19E-127 and BLAST sequence identity of 64.3
  misc_feature (1)..(426): useful for making plants with altered flowering time as described in USSN 12/281,616
MEFQDHFSQEMVLHQQQQQQQQQQNAVLRSMLPESPHHDARKSPPTWLNTSLLRQQHSQFGNASSPSSAAAAAAVAGGNNFLHLQTSNSDSSNSNQWLSPTAAAGGGSNGGGSGHNDELSESMNFAKKMSQQHSGGGEENNNNNNNNNNNNNEEENSWEREKCKADILNHPLYDQLLSAHVSCLRIATPVDQLPRIDAQLAQSQNVVAKYSVLGQGQPPLDDKDLDQFMTHYVLLLSSFKEQLQQHVRVHAMEAVMACWELEQSLQSLTGVAPGEGTGATMSDDDDDQADSDTNFLDGGFDGPDSMGFGPLVPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSTSSSQKSQTQECR

SEQ ID NO: 8165 - DNA, 1218 bp, Arabidopsis thaliana
  misc_feature (1)..(1218): Ceres CLONE ID no.19080
  misc_feature (1)..(1218): Ceres LOCUS ID At5g60850
  misc_feature (1)..(1218): useful for making plants with altered flowering time as described in USSN 12/281,616
atgctcaccacttcacctctctctctctttcttctccactgtaacctcccaattcaaaaacaattataaaccaaacttgattaatatatatttctttatcatcatctcttcgaaatgcaagatattcatgatttctccatgaacggagttggtggtgggggaggaggaggagggaggtttttcggtggaggaatcggcggcggaggaggtggtgatcgaaggatgagagctcatcagaacaatatacttaaccatcatcaatctctcaagtgtcctcgttgtaattctcttaacacaaagttctgttactacaacaattacaatctttctcagcctcgtcacttttgcaagaactgtcgtcgttactggactaaaggtggtgttctccgtaacgttcccgtcggaggtggttgccggaaagctaaacgttcgaaaacaaaacaggttccgtcgtcgtcatcagccgacaaaccaacgacgacgcaagatgatcatcacgtggaggagaaatcgagtacaggatctcactctagcagcgagagctcttctctcaccgcttctaactctaccaccgtcgccgccgtctccgtcaccgcggcggcggaagttgcttcgtcggttattccaggttttgatatgcctaatatgaaaatttacggtaacgggatcgagtggtcgacgttacttggacaaggctcatcggccggtggtgttttctcggagatcggtggttttccggcggtttcagctattgaaactacaccgtttggattcgggggtaaattcgtaaatcaagatgatcatctgaagttagaaggtgaaactgtacagcagcaacagtttggagatcgaacggctcaggttgagtttcaaggaagatcttcggatccgaatatgggatttgaaccgttggattggggaagtggcggtggagatcaaacactgtttgatttaaccagtaccgttgatcatgcatactggagtcaaagtcaatggacgtcgtctgaccaagatcagagtggtctctaccttccttgattctgatcatagcttcttcttcttaacccaaaaatatatattttatacacataaggtaaagttcgatgaagtggttttttwaatttttatttgatgggtctaaaacgggatttattatataattatatgactgcttgtaaatttttttcccaaatatcaaatttacctctcttttttttt

SEQ ID NO: 8166 - protein, 307 aa, Arabidopsis thaliana; identical to SEQ ID NO: 7470
  misc_feature (1)..(307): Ceres CLONE ID NO.19080
  misc_feature (1)..(307): Ceres LOCUS ID At5g60850
  misc_feature (46)..(108): Pfam Name: zf-Dof Pfam Description: Dof domain, zinc finger
  misc_feature (1)..(307): useful for making plants with altered flowering time as described in USSN 12/281,616

SEQ ID NO: 8167 - protein, 336 aa, Arabidopsis thaliana
  misc_feature (1)..(336): Public GI ID NO.5059396
  misc_feature (45)..(107): Pfam Name: zf-Dof Pfam Description: Dof domain, zinc finger
  misc_feature (1)..(336): Functional Homolog of  Ceres CLONE NO.19080 with e-value of 2.20E-140 and BLAST sequence identity of 92.5
  misc_feature (1)..(336): useful for making plants with altered flowering time as described in USSN 12/281,616
MQDIHDFSMNGVGGGGGGGGRFFGGGIGGGGGDRRMRAHQNNILNHHQSLKCPRCNSLNTKFCYYNNYNLSQPRHFCKNCRRYWTKGGVLRNVPVGGRSRKAKRSKTKQVPSSSSADKPTTTQDDHHVEEKSSTGSHSSSETLLSPLLTLPPSPPSPSPRRQVASSVIPGFDMPNMKIYGNGIEWSTLLGQGSSAGGVFSEIGGFPAVSAIETTPFGFGGKFVNQDDHLKLEGETVQQQQFGDRTAQVEFQGRSSDPNMGFEPLDWGSGGGDQTLFDLTSTVIMHTGVKVNGRRLTKIRVVSTFLDSDHSFFFLTQKYIFYTHKVKFDEVVFLIFI

SEQ ID NO: 8168 - DNA, 966 bp, Populus balsamifera subsp. trichocarpa
  misc_feature (1)..(966): Ceres ANNOT ID no.1473196
  misc_feature (1)..(966): useful for making plants with altered flowering time as described in USSN 12/281,616
atgcaagacacccactcaattggtggcggaggcaggttatttagcggtggaggtgggggtgacaggcgactacggccacaccaccaccagaaccaccaagcattaaagtgcccacgatgtgactcgctgaacacgaaattctgttactacaacaactacaacctctctcagcctcgtcacttctgtaagagttgccggcgttactggactaaaggcggtgtcctccgcaacgttcctgttggcggtggatgccgcaagaccaagcggtctaagcttaaacaaaacacaccaagtacaacttctgatgcaattacaacctccagtactagaccgcaggagctacaggaacaacatcagcgacgagatcatatgtcctccaactctcattctagtagtgagagttcgagtcttacggctacaaataacacgaatgcaaatacagcagtggaagcagtgtctgcgctttctgtaaattctgtttccaataatttattaaatggtattgttgagtccaaaatctttccacgtggggatatgaatcccagtttcgaacctgctttgctcgagcaaggatcggactgtgggattttctcggagattgggagtttcacaagcttgatcacatcgacgaacgacttgtcgtttggatttagcaacacaacgaaccaacagcagcaacaagggcttgagcatcatgtgcagaacaatcagaaccagcagcagtggcaaaatcagcatcaggagatgacaggaggagggttgattgatcagacgattcacgctgagttatcagctttgccgagtagtagtagatcaacagagaataccggtgggggatttggagcgttggattggcagttagggagtggagatcaagctggtgggtttttttatcttcctaataccgttgatcaagcttactggagtcagagccaatggaatgatatgactgcttacctcccgtaa

SEQ ID NO: 8169 - protein, 321 aa, Populus balsamifera subsp. trichocarpa
  misc_feature (1)..(321): Ceres ANNOT ID NO.1473196
  misc_feature (30)..(92): Pfam Name: zf-Dof Pfam Description: Dof domain, zinc finger
  misc_feature (1)..(321): Functional Homolog of  Ceres CLONE NO.19080 with e-value of 1.39E-60 and BLAST sequence identity of 57.8
  misc_feature (1)..(321): useful for making plants with altered flowering time as described in USSN 12/281,616
MQDTHSIGGGGRLFSGGGGGDRRLRPHHHQNHQALKCPRCDSLNTKFCYYNNYNLSQPRHFCKSCRRYWTKGGVLRNVPVGGGCRKTKRSKLKQNTPSTTSDAITTSSTRPQELQEQHQRRDHMSSNSHSSSESSSLTATNNTNANTAVEAVSALSVNSVSNNLLNGIVESKIFPRGDMNPSFEPALLEQGSDCGIFSEIGSFTSLITSTNDLSFGFSNTTNQQQQQGLEHHVQNNQNQQQWQNQHQEMTGGGLIDQTIHAELSALPSSSRSTENTGGGFGALDWQLGSGDQAGGFFYLPNTVDQAYWSQSQWNDMTAYLP

SEQ ID NO: 8170 - DNA, 1594 bp, Glycine max
  misc_feature (1)..(1594): Ceres CLONE ID no.1640653
  misc_feature (1)..(1594): useful for making plants with altered flowering time as described in USSN 12/281,616
agtccgaagactctttctctcttctctttcacgctattccccgaaaccttgtttccacactgacacacactccttcacccaacaccaacagaacaataaaacatagtacactacacagtgaaaaagagagagaactctctcttctttctttctttctttctttctcagtcacataacacaaaaaacattactaaacttcaggtttcgtttgtggccggaaatgcaggaaatacactccatcggcggcggaaggttcttcggcggcggcggcgaccggaggctgaggccgcaccaccagaaccaccaccagcagccgccgataaaatgcccccgctgcgactcactcaacaccaagttctgctactacaacaactacaacctctcccagccgcgccatttctgcaagaactgccgtcgctactggaccaaaggcggcgtcctccgcaacgtccccgttggcggcggttgccggaaatcaaaacgctccaacaagcccaaaaccaccacctcagccgccgccaccaccagcagcaacaataacaataacaacccttcctcttcctcggaaaccgctgcggcaaccgcaccaacgccaccacaacaaccgcctccgccacttgagctagagcataattctcactctcactccagcagcgaaagctccacttataccgtcgctgccacggaggccatgtcagcgccgacaacgaatgcggtgtcgaacaacaatttattacttgacaacaaccgtgagtcgaagatgttcgctaaccctaacccctatttagagcagagtcgtagtggtggccttttctctgacatagagagcttcagcagcctcgtcaatttaaacaaccaagcattggggtttgggtttgggaacaataatagcaacatcagcatcctcgatgcgacgtcgtttcggtttggtgttagtgttactaatccgcacgggaatgatcaggtgcttgcggcaccaggtggaggccatggtcagtggcaacaacaacagcagaatcatcatgagttcggtacggcgtcgtttcttgatcacaccgtgccgcttgagttttcttcgctgcagcataaagctgggcatcagggagggtttggaccgttggattggcaacccggtggggatcaaggtttgtttgatcttcctaacactgttgatcaaccttactggacacaccacactcattggtctgatcaagataatccttcttctctctttcatcttccctgaaagtactcaagaaatttctctttttttttgttttttatgacctgagaggaaaagcgtaaaagaatatttgtttggagtctaaagcaacgtagaaaaacaaattggaagagaacctggaaggaacttctaattaaaatatgtaaatttctggtttttttacttttctttttttgggggggtgattgggcttgatcataagtagtgatgttctaatgttcatgtgaaactaacatccatgttagttttttttgcttatgttttattttatgtacttattatttggaatttatttactaggggggaaaacataggagcgttttactttttaacaaaaaaaaaaaaaaaaaa

SEQ ID NO: 8171 - protein, 341 aa, Glycine max
  misc_feature (1)..(341): Ceres CLONE ID NO.1640653
  misc_feature (29)..(91): Pfam Name: zf-Dof Pfam Description: Dof domain, zinc finger
  misc_feature (1)..(341): Functional Homolog of  Ceres CLONE NO.19080 with e-value of 8.90E-50 and BLAST sequence identity of 54.5
  misc_feature (1)..(341): useful for making plants with altered flowering time as described in USSN 12/281,616
MQEIHSIGGGRFFGGGGDRRLRPHHQNHHQQPPIKCPRCDSLNTKFCYYNNYNLSQPRHFCKNCRRYWTKGGVLRNVPVGGGCRKSKRSNKPKTTTSAAATTSSNNNNNNPSSSSETAAATAPTPPQQPPPPLELEHNSHSHSSSESSTYTVAATEAMSAPTTNAVSNNNLLLDNNRESKMFANPNPYLEQSRSGGLFSDIESFSSLVNLNNQALGFGFGNNNSNISILDATSFRFGVSVTNPHGNDQVLAAPGGGHGQWQQQQQNHHEFGTASFLDHTVPLEFSSLQHKAGHQGGFGPLDWQPGGDQGLFDLPNTVDQPYWTHHTHWSDQDNPSSLFHLP

SEQ ID NO: 8172 - protein, 282 aa, Oryza sativa subsp. japonica
  misc_feature (1)..(282): Public GI ID NO.51979356
  misc_feature (40)..(102): Pfam Name: zf-Dof Pfam Description: Dof domain, zinc finger
  misc_feature (1)..(282): Functional Homolog of  Ceres CLONE NO.19080 and BLAST sequence identity of 53.0
  misc_feature (1)..(282): useful for making plants with altered flowering time as described in USSN 12/281,616
MQEFQSIPGLAGRLFGGAAAADIRRAQAQQGPASRCGGIPSPEAVKCPRCESTNTKFCYYNNYNLSQPRHFCKSCRRYWTKGGVLRNVPVGGGCRKTKRSGSSSAASSAPSTPTAATDNAKNQRRASASSPRSSSGGSGNTSPTAAAATTPTTPATPSSNTIAVINHATTTTTTTNPFPTDVPPPAPIFADQAAALASLFAPPPPPPLPVFSFAAQAKTEDGIASVLLAGQTTAPTAATVADMTPFTSLDAGIFELGDVPPAAYWNAGSCWTDVPDPNVYLP

SEQ ID NO: 8173 - protein, 291 aa, Triticum aestivum
  misc_feature (1)..(291): Public GI ID NO.67523403
  misc_feature (43)..(105): Pfam Name: zf-Dof Pfam Description: Dof domain, zinc finger
  misc_feature (1)..(291): Functional Homolog of  Ceres CLONE NO.19080 with e-value of 5.10E-31 and BLAST sequence identity of 58.0
  misc_feature (1)..(291): useful for making plants with altered flowering time as described in USSN 12/281,616
MQDFQSIPGLAGRLFGGAAAADIRRVQGPASRCGVFSQAASAQPEAAVKCPRCESTNTKFCYYNNYNLSQPRHFCKSCRRYWTKGGVLRNVPVGGGCRKAKRSSSSASAPSTPAATDAKSQRRASASSSSRSNSGSGSASPTAAAEETTTTETEPPPPPTPSSNSNSNAVSFANRMTNYPFAADVPPLAPIFADQAAALASLFAPPPPPPLPVFSFSAEPKMEEAIGSLLLPGQEASQEPEEPTCTSTVADMAPFMSLDAGIFELGDASPADYWNGGSCWTDVQDPSVYLP

SEQ ID NO: 8174 - DNA, 1105 bp, Arabidopsis thaliana
  misc_feature (1)..(1105): Ceres CLONE ID no.33231
  misc_feature (1)..(1105): Ceres LOCUS ID At5g60660
  misc_feature (1)..(1105): useful for making plants with altered flowering time as described in USSN 12/281,616
aacattaaaactcatctctctcatcatctttggccatggcaaaagacttggatgtgaacgagagtggaccaccggcggcgagagactacaaggatccgcctcccgcaccatttttcgacatggaggagcttaggaaatggccgctttatagagcggtcatagctgagtttgtagcaacacttctgttcctctacgtctcaatcctgactgtaatcggctacaaagctcaaaccgatgcaaccgccggaggagtggattgtggcggcgtaggaatattgggtattgcgtgggctttcggtggaatgatctttgttctcgtttactgtaccgccggtatctccggtggtcatataaatccggctgtgacggtgggactattcctggctcgtaaagtgtcattggtgcggacagtgttatacattgtggctcagtgccttggtgccatctgcggttgcggtttcgtcaaagcattccaaagttcttactacaccagatatggaggtggagccaacgagctagccgatggctacaacaaaggtaccggactcggtgccgagatcattggaacttttgtccttgtatacaccgtcttctcggcaaccgatcccaagcgaaatgctcgtgactctcacgtgccagttttggctccacttcccattggctttgccgtcttcatggttcatttagccaccattcccatcaccggaaccggtatcaacccggctcgtagctttggagctgccgttatttacaacaacgaaaaggcctgggacgaccaatggattttttgggttggaccgatgatcggagcagcagcagcagcgttttaccatcagtttattttaagagcggctgcgattaaagctcttggctcatttggctcctttggctcctttaggagctttgcttaatatacatttattttaaattaaaccacaagttataaatctttgatcaaaattaaaaggatgattacaaatgaattaagtggaagttacatgtgatcttctttttatatgtttctgtttttttgttctctctttcatttcatggaatttcccattcgtgtaattgtaaatgtggttttaattaatgttgctttaag

SEQ ID NO: 8175 - protein, 291 aa, Arabidopsis thaliana
  misc_feature (1)..(291): Ceres CLONE ID NO.33231
  misc_feature (1)..(291): Ceres LOCUS ID At5g60660
  misc_feature (31)..(266): Pfam Name: MIP Pfam Description: Major intrinsic protein
  misc_feature (1)..(291): useful for making plants with altered flowering time as described in USSN 12/281,616
MAKDLDVNESGPPAARDYKDPPPAPFFDMEELRKWPLYRAVIAEFVATLLFLYVSILTVIGYKAQTDATAGGVDCGGVGILGIAWAFGGMIFVLVYCTAGISGGHINPAVTVGLFLARKVSLVRTVLYIVAQCLGAICGCGFVKAFQSSYYTRYGGGANELADGYNKGTGLGAEIIGTFVLVYTVFSATDPKRNARDSHVPVLAPLPIGFAVFMVHLATIPITGTGINPARSFGAAVIYNNEKAWDDQWIFWVGPMIGAAAAAFYHQFILRAAAIKALGSFGSFGSFRSFA

SEQ ID NO: 8176 - DNA, 858 bp, Populus balsamifera subsp. trichocarpa
  misc_feature (1)..(858): Ceres ANNOT ID no.1457917
  misc_feature (1)..(858): useful for making plants with altered flowering time as described in USSN 12/281,616
atggcaaaggatactgaagtggcagaggcaggatcattctctgcaaaagattaccaagacccacccccagcaccattgattgatgccgaagagctaacaaagtggtcattttacagggccttgattgctgagtttatagcaactatgctctttctttacatcactgttttgactgttattgggtacaaaagccagattgatggaaatgctgatccttgtggtggggttggtattcttggtattgcttgggcctttggtggcatgatctttgttcttgtttactgcactgctggtatttcagggggtcacattaacccagcagtgacatttgggctgttcttggccaggaaggtgtctttgatcagggctgtgatgtacatggtggcccaatgcgcgggagccatatgtggtgttgggttggtcaaggccttccaaaagtcttactacacaaaatataatggcggagccaacgttttggctgatgggtacagcacaggcactggattgggcgctgagattattgggacttttgtcctggtctacactgtgttctctgctactgatcccaagaggagtgctagggactcccatgtgcctgtattggctcctctcccaattggatttgctgtgttcatggttcacttggccaccatcccaatcacaggaactggcatcaaccctgctaggagttttggagctgctgttatctacaacaacaagaaggcctggcatgaccagtggatcttttgggctggacccttcattggtgcagccatagcagccttctaccaccaattcatcttgagagcaggagctattaaggctctcgggtcattcaggagcaacccgaatgtctaa

SEQ ID NO: 8177 - protein, 285 aa, Populus balsamifera subsp. trichocarpa
  misc_feature (1)..(285): Ceres ANNOT ID NO.1457917
  misc_feature (31)..(264): Pfam Name: MIP Pfam Description: Major intrinsic protein
  misc_feature (1)..(285): Functional Homolog of  Ceres CLONE NO.33231 with e-value of 9.70E-124 and BLAST sequence identity of 82.5
  misc_feature (1)..(285): useful for making plants with altered flowering time as described in USSN 12/281,616
MAKDTEVAEAGSFSAKDYQDPPPAPLIDAEELTKWSFYRALIAEFIATMLFLYITVLTVIGYKSQIDGNADPCGGVGILGIAWAFGGMIFVLVYCTAGISGGHINPAVTFGLFLARKVSLIRAVMYMVAQCAGAICGVGLVKAFQKSYYTKYNGGANVLADGYSTGTGLGAEIIGTFVLVYTVFSATDPKRSARDSHVPVLAPLPIGFAVFMVHLATIPITGTGINPARSFGAAVIYNNKKAWHDQWIFWAGPFIGAAIAAFYHQFILRAGAIKALGSFRSNPNV

SEQ ID NO: 8178 - DNA, 909 bp, Populus balsamifera subsp. trichocarpa
  misc_feature (1)..(909): Ceres ANNOT ID no.1462053
  misc_feature (1)..(909): useful for making plants with altered flowering time as described in USSN 12/281,616
atggcgaaggatattgaggttgcagagcatggagagactgtgaaggactaccaggacccacctccagctccattgattgatgctgaggagctaggacaatggtccttttacagggctcttattgcagaattcatcgccacccttctcttcctttatgtcacagtcttgactgttattggatacaaaagccagacagacccagacaagggtctggatgcttgtggtggtgttggcattcttggtattgcttgggccttcggtggcatgatctttgtccttgtttactgcactgctggtatctctggaggacacatcaacccagcagtgacctttggtctgtttctggcgaggaaggtgtcgctcatcagggctgttttgtacatggtggcacagtgcttgggtgcgatatgcggctgtggtttggtgaaggccttccaaaagtcttattacaatcactatggaggcggagccaacgagctgcaggaagggtacaacaagggcactggattgggtgctgaaatcatcggtacttttgttcttgtctacactgtcttctccgccactgatcccaagaggaatgctagagactcccatgttcctcatgagggtcgtttcctttctgactttgattgtttttctcatctcgggatcttggtattggcacctctccccattggatttgctgtgttcatggttcacctcgccacaatcccaattactggtactggcatcaaccctgctaggagcttcggagctgctgttatctttaaccaaagcaaggcctgggatgaccattggctcttctgggttggacccttcattggagctgccattgctgctttctaccaccagttcattcttagagcagcggctattaaggctctaggatccttcaggagcaatgcttaa

SEQ ID NO: 8179 - protein, 302 aa, Populus balsamifera subsp. trichocarpa
  misc_feature (1)..(302): Ceres ANNOT ID NO.1462053
  misc_feature (1)..(302): Functional Homolog of  Ceres CLONE NO.33231 with e-value of 7.80E-122 and BLAST sequence identity of 84.0
  misc_feature (1)..(302): useful for making plants with altered flowering time as described in USSN 12/281,616
MAKDIEVAEHGETVKDYQDPPPAPLIDAEELGQWSFYRALIAEFIATLLFLYVTVLTVIGYKSQTDPDKGLDACGGVGILGIAWAFGGMIFVLVYCTAGISGGHINPAVTFGLFLARKVSLIRAVLYMVAQCLGAICGCGLVKAFQKSYYNHYGGGANELQEGYNKGTGLGAEIIGTFVLVYTVFSATDPKRNARDSHVPHEGRFLSDFDCFSHLGILVLAPLPIGFAVFMVHLATIPITGTGINPARSFGAAVIFNQSKAWDDHWLFWVGPFIGAAIAAFYHQFILRAAAIKALGSFRSNA

SEQ ID NO: 8180 - DNA, 858 bp, Populus balsamifera subsp. trichocarpa
  misc_feature (1)..(858): Ceres ANNOT ID no.1475405
  misc_feature (1)..(858): useful for making plants with altered flowering time as described in USSN 12/281,616
atgggcaaggacattgaagttggaggcgagttcagtgccaaggactatcatgaccctccgccagcgccattgatcgatgctgaggaaataacccagtggtctttttatcgggctattattgctgagttcgttgccacgctcttgtttctgtacatcactgttttgaccgtgataggttacaagagccagactgacgttaataaaaacggtgatgaatgtggtggggttggcattcttggcatcgcttgggcctttggtggcatgatttttattcttgtttactgcactgctggtatctcaggtggacatattaacccggctgtgactttcggtttgttcttggctaggaaggtctccttggtgcgtgccattctatacatggtggctcagtgcctgggggccatatgtggatgtggacttgtgaaagcattccaaaagtcttattacacaaactatggtggtggagccaatggacttgctaacggatacagcaagggaactgggttaggtgctgagatcattggcacctttgttcttgtctacactgttttctctgctaccgaccccaagaggaatgcaagggattctcatgttcctgtactggcaccacttcccattggatttgctgttttcatggttcacctggccactattccaatcaccggtactggtatcaaccctgctaggagcttcggagctgcagtgatcttcaacaaggaaaaggcatgggatgaccattggattttctgggttggacctttcattggtgctgcaattgctgccttatatcaccagttcatcttgagagcagctgctgttaaatcccttggatccttccggagctctcccaacatataa

SEQ ID NO: 8181 - protein, 285 aa, Populus balsamifera subsp. trichocarpa
  misc_feature (1)..(285): Ceres ANNOT ID NO.1475405
  misc_feature (29)..(264): Pfam Name: MIP Pfam Description: Major intrinsic protein
  misc_feature (1)..(285): Functional Homolog of  Ceres CLONE NO.33231 with e-value of 7.39E-126 and BLAST sequence identity of 82.9
  misc_feature (1)..(285): useful for making plants with altered flowering time as described in USSN 12/281,616
MGKDIEVGGEFSAKDYHDPPPAPLIDAEEITQWSFYRAIIAEFVATLLFLYITVLTVIGYKSQTDVNKNGDECGGVGILGIAWAFGGMIFILVYCTAGISGGHINPAVTFGLFLARKVSLVRAILYMVAQCLGAICGCGLVKAFQKSYYTNYGGGANGLANGYSKGTGLGAEIIGTFVLVYTVFSATDPKRNARDSHVPVLAPLPIGFAVFMVHLATIPITGTGINPARSFGAAVIFNKEKAWDDHWIFWVGPFIGAAIAALYHQFILRAAAVKSLGSFRSSPNI

SEQ ID NO: 8182 - DNA, 858 bp, Populus balsamifera subsp. trichocarpa
  misc_feature (1)..(858): Ceres ANNOT ID no.1484924
  misc_feature (1)..(858): useful for making plants with altered flowering time as described in USSN 12/281,616
atgggcaaggacgttgaagttagaggcgaattcattgccaaggactatcatgaccctccaccagcaccattgattgatgccgaggagctcacccagtggtctttgtatagggccatcattgccgagttcattgccacgctcttgtttctctacatcactgtgttgactgtgataggttacaagagccagactgacacgaccaagaacagcgatgcatgtggtggggttggcattcttggcatcgcttgggcctttggtggcatgatctttgttcttgtctactgcactgctggtatctcaggtggacacattaacccggctgtgactttcggtttgttcttggctaggaaggtgtccctggtgcgtgccgttctatacatggtggctcagtgcctgggggccatatgtggatgtggactcgtgaaagctttccaaaagtcgtattacacaaagtacggtggtggagccaatgaacttgctactggattcagcaagggcactggattaggtgctgagatcatcggtacctttgttctcgtctacactgtcttctctgctactgacccaaagaggaacgcaagggactcccatgttcccgtgttggcaccacttcccatcggatttgctgtcttcatggttcacttggccactattccaatcactggaactggtatcaacccagctaggagctttggagctgctgtgatatacaacaaagacaaggcatgggatgaccattggatcttctgggtcgggcctttcattggggccgcaattgctgcattgtatcaccaatacgtcctgagagcagctgctgttaaagcccttgggtccttcaggagctcttccaacatttaa

SEQ ID NO: 8183 - protein, 285 aa, Populus balsamifera subsp. trichocarpa
  misc_feature (1)..(285): Ceres ANNOT ID NO.1484924
  misc_feature (29)..(264): Pfam Name: MIP Pfam Description: Major intrinsic protein
  misc_feature (1)..(285): Functional Homolog of  Ceres CLONE NO.33231 with e-value of 4.50E-126 and BLAST sequence identity of 83.6
  misc_feature (1)..(285): useful for making plants with altered flowering time as described in USSN 12/281,616
MGKDVEVRGEFIAKDYHDPPPAPLIDAEELTQWSLYRAIIAEFIATLLFLYITVLTVIGYKSQTDTTKNSDACGGVGILGIAWAFGGMIFVLVYCTAGISGGHINPAVTFGLFLARKVSLVRAVLYMVAQCLGAICGCGLVKAFQKSYYTKYGGGANELATGFSKGTGLGAEIIGTFVLVYTVFSATDPKRNARDSHVPVLAPLPIGFAVFMVHLATIPITGTGINPARSFGAAVIYNKDKAWDDHWIFWVGPFIGAAIAALYHQYVLRAAAVKALGSFRSSSNI

SEQ ID NO: 8184 - DNA, 858 bp, Populus balsamifera subsp. trichocarpa
  misc_feature (1)..(858): Ceres ANNOT ID no.1484925
  misc_feature (1)..(858): useful for making plants with altered flowering time as described in USSN 12/281,616
atgggcaaggacattgaagttggaggcgaattcagtgccaaggactatcatgaccctccaccagcaccattgattgatgccgaggagctcacccagtggtctttgtatagggctatcattgccgagttcattgccacgctcttgtttctctacatcactgtgttgactgtgataggttacaagagccagactgacacgaccaagaacagcgatgcatgtggtggggttggcattcttggcatcgcttgggcctttggtggcatgatctttgttcttgtctactgcactgctggtatctcaggtggacacattaacccggctgtgactttcggtttgttcttggctaggaaggtgtccctggtgcgtgccgttctatacatggtggctcagtgcttgggggccatatgtggatgtggactcgtgaaagctttccaaaagtcgtattacacaaagtacggtggtggagtcaatgaacttgctacaggattcagcaagggcactggattaggtgctgagatcatcggtacctttgttctcgtctacactgtcttctctgctactgacccaaagaggaacgcaagggactcccatgttcctgtgttggcaccacttcccatcggatttgctgtcttcatggttcacctggccactattccaatcactggaactggtatcaacccagctaggagctttggagctgctgtgatatacaacgaagacaaggcatgggatgaccattggatcttctgggtcgggcctttcattggggccgcaattgctgcattgtatcaccaatacgtcctgagagcagctgctgttaaagcccttgggtccttcaggagctcttccaacatttaa

SEQ ID NO: 8185 - protein, 285 aa, Populus balsamifera subsp. trichocarpa
  misc_feature (1)..(285): Ceres ANNOT ID NO.1484925
  misc_feature (29)..(264): Pfam Name: MIP Pfam Description: Major intrinsic protein
  misc_feature (1)..(285): Functional Homolog of  Ceres CLONE NO.33231 with e-value of 5.80E-126 and BLAST sequence identity of 83.2
  misc_feature (1)..(285): useful for making plants with altered flowering time as described in USSN 12/281,616
MGKDIEVGGEFSAKDYHDPPPAPLIDAEELTQWSLYRAIIAEFIATLLFLYITVLTVIGYKSQTDTTKNSDACGGVGILGIAWAFGGMIFVLVYCTAGISGGHINPAVTFGLFLARKVSLVRAVLYMVAQCLGAICGCGLVKAFQKSYYTKYGGGVNELATGFSKGTGLGAEIIGTFVLVYTVFSATDPKRNARDSHVPVLAPLPIGFAVFMVHLATIPITGTGINPARSFGAAVIYNEDKAWDDHWIFWVGPFIGAAIAALYHQYVLRAAAVKALGSFRSSSNI

SEQ ID NO: 8186 - DNA, 858 bp, Populus balsamifera subsp. trichocarpa
  misc_feature (1)..(858): Ceres ANNOT ID no.1518415
  misc_feature (1)..(858): useful for making plants with altered flowering time as described in USSN 12/281,616
atggcgaaggacatggaagttgcagaggcaggatcattctctgcgaaggactaccatgacccaccaccagcaccattgtttgatgctaaagagttaacaaagtggtcattttacagggccttgattgctgagtttatagcaacactgctctttctttatatcactgttttgactgttattggttacaagagccagattgatggaagtgctgattcttgtggtggggttggtattcttggtattgcctgggcctttggtggcatgatctttgttcttgtatactgcactgctggtatttcagggggtcacattaacccagcagtgacatttgggcttttcctagccaggaaggtctctttgatccgggctgtgatgtacatggtggctcaatgcttaggagccatatgtggcgttgggcttgttaaggccttccaaaagtcttactacaagaagtatggtggtggagccaacactttggccgatgggttcagcaccggcactggattgggtgctgagatcattggcacttttgtcctggtctacactgttttctctgctacagatccaaagaggagtgctagggactcccatgtgcctgttttggctcctcttccaattggatttgctgtgttcatggttcacttggccaccatccccatcactggaactggcatcaaccctgctaggagtctgggagccgctgttatctacaaccaagacaaggcctgggatggccattggatcttctgggttggacccttcgctggtgcagccattgcagctttctaccaccaattcatcttgagagcaggagctgtcaaggctcttggatcattcaggagcgcccaacggttttaa

SEQ ID NO: 8187 - protein, 285 aa, Populus balsamifera subsp. trichocarpa
  misc_feature (1)..(285): Ceres ANNOT ID NO.1518415
  misc_feature (31)..(264): Pfam Name: MIP Pfam Description: Major intrinsic protein
  misc_feature (1)..(285): Functional Homolog of  Ceres CLONE NO.33231 with e-value of 6.79E-123 and BLAST sequence identity of 80.7
  misc_feature (1)..(285): useful for making plants with altered flowering time as described in USSN 12/281,616
MAKDMEVAEAGSFSAKDYHDPPPAPLFDAKELTKWSFYRALIAEFIATLLFLYITVLTVIGYKSQIDGSADSCGGVGILGIAWAFGGMIFVLVYCTAGISGGHINPAVTFGLFLARKVSLIRAVMYMVAQCLGAICGVGLVKAFQKSYYKKYGGGANTLADGFSTGTGLGAEIIGTFVLVYTVFSATDPKRSARDSHVPVLAPLPIGFAVFMVHLATIPITGTGINPARSLGAAVIYNQDKAWDGHWIFWVGPFAGAAIAAFYHQFILRAGAVKALGSFRSAQRF

SEQ ID NO: 8188 - DNA, 1060 bp, Arabidopsis thaliana
  misc_feature (1)..(1060): Ceres CLONE ID no.11998
  misc_feature (1)..(1060): Ceres LOCUS ID At2g37180
  misc_feature (1)..(1060): useful for making plants with altered flowering time as described in USSN 12/281,616
acaagccctacaacaaccacaaagcaaaacacttacttagaaagtccagaaacatccattaacacatatggctaaagacgtggaaggatctgatggatttcagacgagagattacgaagatcctccgccaacaccgtttttcgacgcagaggagcttaccaagtggtctttatacagagcagtcatcgccgagttcgtagccactctcctcttcttgtacgtcaccgttttaactgtcattggttacaagattcagtccgacacaaaagccggtggagttgactgcggcggcgtcggaatccttggcatcgcgtgggcttttggtggcatgatcttcatccttgtctactgcaccgccggtatctcaggtggtcacataaaccctgcggtgacgtttggtttgttcttagcccggaaggtatcgctgattagggcggtgctttacatggtggctcagtgtttgggtgctatttgtggagttgggtttgtgaaggcatttcaaagctctcactatgttaattacggtggaggagccaactttctagctgacggctacaatacaggcaccggactcgcggcagagatcatcggaacattcgtgcttgtctacacagtcttctccgctactgatcccaaacgcaacgctagagactcccacgttccggttttggcgccacttccgattgggtttgcggtgtttatggtacatttggccactattccgatcaccggaaccggtatcaacccggctaggagtttcggagccgccgtaatctttaacaagagcaagccatgggatgaccactggatattctgggtgggaccattcattggagctacgatagctgcattttatcaccaattcgttctaagggcctcaggctccaagtccctcggttcattcagaagtgcagccaacgtttaaacttagccacgaaagaaaaaaagtgtgcctacaattatgtagaaacatatcctcttttccactcgtatcttagcttcttcctattttctatttctaactgtgtgattccatattaaatcgagtgaaatgtttttc

SEQ ID NO: 8189 - protein, 285 aa, Arabidopsis thaliana
  misc_feature (1)..(285): Ceres CLONE ID NO.11998
  misc_feature (1)..(285): Ceres LOCUS ID At2g37180
  misc_feature (29)..(264): Pfam Name: MIP Pfam Description: Major intrinsic protein
  misc_feature (1)..(285): Functional Homolog of  Ceres CLONE NO.33231 with e-value of 2.49E-125 and BLAST sequence identity of 83.6
  misc_feature (1)..(285): useful for making plants with altered flowering time as described in USSN 12/281,616
MAKDVEGSDGFQTRDYEDPPPTPFFDAEELTKWSLYRAVIAEFVATLLFLYVTVLTVIGYKIQSDTKAGGVDCGGVGILGIAWAFGGMIFILVYCTAGISGGHINPAVTFGLFLARKVSLIRAVLYMVAQCLGAICGVGFVKAFQSSHYVNYGGGANFLADGYNTGTGLAAEIIGTFVLVYTVFSATDPKRNARDSHVPVLAPLPIGFAVFMVHLATIPITGTGINPARSFGAAVIFNKSKPWDDHWIFWVGPFIGATIAAFYHQFVLRASGSKSLGSFRSAANV

SEQ ID NO: 8190 - DNA, 1558 bp, Zea mays
  misc_feature (1)..(1558): Ceres CLONE ID NO.219143
  misc_feature (1)..(1558): useful for making plants with altered flowering time as described in USSN 12/281,616
ggggggatccttggctttacagcacaaacctcgatagcctatccagccagcatcgttggattggagcacgcaaacaaaaccaaaagggagagcgacagcgwcaggaaataatacccaggggaaaaaacagagagagaaagaaaagaaaagaaaagaaaaggccattcaatcttatcaacacaaagttgatttaataaaaaaaggcaggaatcggtacagaagctgctgaattttctgttccattccatcaagcaataatgaagcgggggagcatggcccgccccagccttgcagcactattgtgctttgttgtcacttacctactcttcactccctccataaatagcaccactgcaccctctccttcgcgcactcatccattccatcatcccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgggccttcggcggcatgatcttcgtcctcgtctactgcaccgccggcatctcggggggccacatcaaccccgccgtcaccttcggcctcttcctggcgcgcaaggtctccctggtgcgcgcgctgctctacatcgtggcgcagtgcctcggcgccatctgcggcgtcggcctcgtcaaggcgttccagagcgcctacttcgacaggtacggcggcggcgccaactcgctcgcctccggctactcccgcggcaccggcctcggcgccgagatcatcggcaccttcgtgctcgtctacaccgtcttctccgccaccgaccccaagcgcaacgcccgcgactcccacgtcccggttctggctcccctccccatcggcttcgccgtgttcatggtgcacctggccaccatccccgtcaccggcaccggcatcaacccggccaggagcctgggcgccgccgtcatctacaacaaggacaagccctgggacgaccactggatcttctgggtgggccctctcgtgggcgctgccatcgcggccttctaccaccagtacatcctccgggctggcgccatcaaggccctcggctccttcaggagcaacgcgtgatgagcggggcttggctgtggagcaatggcgggcgacctacgggcggggggccgtgagcgaggagaatgccatcattcatcgatcgacttgggtgccggtggttggttcgggtcgccttttttttgtttcagcagctgctgcgttgcgcgcgtgcgtgagatttggtttggtttcgttcccctgcaatgtaatcatgtcgtgactctcaagggattattccgctc

SEQ ID NO: 8191 - protein, 290 aa, Zea mays
  misc_feature (1)..(290): Ceres CLONE ID NO.219143
  misc_feature (34)..(271): Pfam Name: MIP Pfam Description: Major intrinsic protein
  misc_feature (1)..(290): Functional Homolog of  Ceres CLONE NO.33231 with e-value of 4.20E-123 and BLAST sequence identity of 83.3
  misc_feature (1)..(290): useful for making plants with altered flowering time as described in USSN 12/281,616
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 8192 - DNA, 1282 bp, Zea mays
  misc_feature (1)..(1282): Ceres CLONE ID NO.224986
  misc_feature (1)..(1282): useful for making plants with altered flowering time as described in USSN 12/281,616
aagcactcatccattccatcatcccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccracgcggcgtgcgrcggcgtgggcgtgctgggcatcgcctgggccttcggcggcatgatcttcgtcctcgtctactgcaccgccggcatctcggggggccacatcaaccccgccgtcaccttcggcctcttcctggcgcgcaaggtctccctggtgcgcgcgctgctctacatcgtggcgcagtgcctcggcgccatctgcggcgtcggcctcgtcaaggcgttccagagcgcctacttcgacaggtacggcggcggcgccaactcgctcgcctccggctactcccgcggcaccggcctcggcgccgagatcatcggcaccttcgtgctcgtctacaccgtcttctccgccaccgaccccaagcgcaacgcccgcgactcccacgtcccggttctggctcccctccccatcggcttcgccgtgttcatggtgcacctggccaccatccccgtcaccggcaccggcatcaacccggccaggagcctgggcgccgccgtcatctacaacaaggacaagccctgggacgaccactggatcttctgggtgggccctctcgtgggcgctgccatcgcggccttctaccaccagtacatcctccgggctggcgccatcaaggccctcggctccttcaggagcaacgcgtgatgagcggggcttggctgtggagcaatggcgggcgacctacgggcggggggccgtgagcgaggagaatgccatcattcatcgatcgacttgggtgccggtggttggttcgggtcgcctttttttttgtttcagcagctgctgcgttgcgcgcgtgcgtgagatttggtttggtttcgttcccctgcaatgtaatcatgtcgtgactctcaagggattattccgctctgctcttatggtctctgttttctatttaatgattgttattaccatgtagcagtaaccatcgtcatcagtgagaaccttgttgcttctgtc

SEQ ID NO: 8193 - protein, 309 aa, Zea mays
  misc_feature (1)..(309): Ceres CLONE ID NO.224986
  misc_feature (34)..(271): Pfam Name: MIP Pfam Description: Major intrinsic protein
  misc_feature (1)..(309): Functional Homolog of  Ceres CLONE NO.33231 with e-value of 1.30E-121 and BLAST sequence identity of 82.6
  misc_feature (1)..(309): useful for making plants with altered flowering time as described in USSN 12/281,616
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKAPRLLQEQRVMSGAWLWSNGGRPTGGGP

SEQ ID NO: 8194 - DNA, 1260 bp, Zea mays
  misc_feature (1)..(1260): Ceres CLONE ID no.229381
  misc_feature (1)..(1260): useful for making plants with altered flowering time as described in USSN 12/281,616
atctccggcctcacaccgcaaccgcaagcaagcgaagcrcgagcctgcctgaccagagctagctgagtgcaacagccaacagcagctggtctgactgacatggcgaaggacatcgaggcatcggggcccgaggcgggcgagttctcggccaaggactacaccgaccctccgccggcgccgctggtcgacgcggaggagctcacccagtggtccctgtaccgcgcggtcatcgccgagttcatcgccacgctgctcttcctctacatcaccgtggccaccgtgatcgggtacaagcaccagacggacgcgtcggcgtcgggccccgacgcggcgtgcggcggcgtcggcatcctcggcatcgcgtgggccttcggcggcatgatcttcatcctcgtctactgcaccgccggcatctcaggtgggcacatcaacccggccgtgaccttcggcctgttcctggccaggaaggtgtccctcgtccgcgcgctgctctacatcgtggcgcagtgcctgggcgccatctgcggcgtgggcctcgtcaagggcttccagagcgcctactacgtgcgctacggcggcggcgccaacgagctcagcgacggctactccaagggcaccggcctcgccgccgagatcatcggcacgttcgtgctcgtctacaccgtcttctccgccaccgaccccaagcgcagtgcccgtgactcccacgttccggtgctagctcctctcccaattgggttcgccgtgttcatggtgcacctggccaccatccccatcaccggcaccggcatcaacccggcgaggagcctgggagccgcggtcatctacaacaaggacaaggcctgggacgaccaatggatcttctgggtgggtccactgattggcgccgccatcgccgccgcctaccaccagtacgtgctgagggccagcgccaccaagctcgggtcctaccggagcaacgcctaagttccgcccggacgcgccaggagctgggcaccgttccaattctgttcctccacatgacgccctgttctgtttccgtgtggccaggactccgcttgctcgctgctgttttctacttcggaccaaagtgtgatatatcgttgctttctgtatatgtatgtaggaatgcatcatgtaacgagaatttggaatacaattgcgtgagtttttatccgatcacaatctattgagtagtggcatataaaaaatgtcctgccctttctttaaacgaatgaaagtaaagaaaagaacctcacg

SEQ ID NO: 8195 - protein, 288 aa, Zea mays
  misc_feature (1)..(288): Ceres CLONE ID NO.229381
  misc_feature (33)..(270): Pfam Name: MIP Pfam Description: Major intrinsic protein
  misc_feature (1)..(288): Functional Homolog of  Ceres CLONE NO.33231 with e-value of 1.10E-122 and BLAST sequence identity of 82.2
  misc_feature (1)..(288): useful for making plants with altered flowering time as described in USSN 12/281,616
MAKDIEASGPEAGEFSAKDYTDPPPAPLVDAEELTQWSLYRAVIAEFIATLLFLYITVATVIGYKHQTDASASGPDAACGGVGILGIAWAFGGMIFILVYCTAGISGGHINPAVTFGLFLARKVSLVRALLYIVAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 8196 - DNA, 1296 bp, Glycine max
  misc_feature (1)..(1296): Ceres CLONE ID no.624259
  misc_feature (1)..(1296): useful for making plants with altered flowering time as described in USSN 12/281,616
cttcaattcactccactttggcacacaacactagctatagtaagctacacttatttgaggttggagaaatatggctaaagatgttgaggttcaagagcaaggaggagagtactctgcaaaagactaccatgaccctcctccagcacccttgttcgacccagaggagctcacacagtggtccttttatagagccctaatcgctgagttcatagcaacccttctcttcctttatgtcaccgtgctcaccattattggctacaaaaggcagactgatgccacgctaggtggcaccgagtgtgatggggttggcattttgggcatcgcttgggcctttggtggcatgatcttcatccttgtttactgcaccgccggtatttcaggaggacacataaacccggcggtgacattcgggctgttcctaggacgcaaggtttcgttgataagggcgttgttgtacatggtagcacagtgtgccggtgctatctgtggcactggattggccaaggggttccaaaaatcatactacaacaggtatggaggtggtgccaactctgttgctgatggctacaacaatggtactgctttgggtgctgagattattggtaccttcgttcttgtctacactgtcttctctgccactgaccctaagaggaacgctagggactcccatgttcctgtactggcaccacttcctattggatttgccgtgttcatggttcacttggctacaatcccaattactggtactggcattaacccagcaaggagtttcggagcagctgtaatctacaacaaggacaaaatctgggatgaccagtggatattctgggttggaccaattgttggagcagcagtggctgcattctaccaccaatacatccttagagcagcagctatcaaggctcttggatccttcagaagcaacgcttaattaattaatcaattaagctaccttaatttgccaacaaggctagctatgagtggtgtttccccggaagaataataatttctatgttgaggagtgccagtgatctgtctctgcagttccctaatttaggctttttcgttttttcctttcatcagctacaattgttggagggtttggaggataaggccaaaaccatagggtcatgcatcaaattgtggataagcatgcttgtgtccaagggtgtattttgtatcccttttgtgtcttttctttttcctttttataatttccatgtatgtattcctcaagtgttccttttcggtcttgtgcatccttagtcatttctgattttaaaaaaaaaaaaaaaa

SEQ ID NO: 8197 - protein, 286 aa, Glycine max
  misc_feature (1)..(286): Ceres CLONE ID NO.624259
  misc_feature (32)..(267): Pfam Name: MIP Pfam Description: Major intrinsic protein
  misc_feature (1)..(286): Functional Homolog of  Ceres CLONE NO.33231 with e-value of 4.50E-126 and BLAST sequence identity of 81.9
  misc_feature (1)..(286): useful for making plants with altered flowering time as described in USSN 12/281,616
MAKDVEVQEQGGEYSAKDYHDPPPAPLFDPEELTQWSFYRALIAEFIATLLFLYVTVLTIIGYKRQTDATLGGTECDGVGILGIAWAFGGMIFILVYCTAGISGGHINPAVTFGLFLGRKVSLIRALLYMVAQCAGAICGTGLAKGFQKSYYNRYGGGANSVADGYNNGTALGAEIIGTFVLVYTVFSATDPKRNARDSHVPVLAPLPIGFAVFMVHLATIPITGTGINPARSFGAAVIYNKDKIWDDQWIFWVGPIVGAAVAAFYHQYILRAAAIKALGSFRSNA

SEQ ID NO: 8198 - DNA, 1263 bp, Glycine max
  misc_feature (1)..(1263): Ceres CLONE ID no.1020667
  misc_feature (1)..(1263): useful for making plants with altered flowering time as described in USSN 12/281,616
accaccacagagagctaagcgcattcgcatcttgagcacagacacccaccctagcttgtcgatcagtcgaggcagcgacgatggccaaggacatcgaggcggcgccccccggaggggagtacggagccaaggactactctgacccgccgccggcgccgctcttcgacgccgaggagctgactaaatggtccctgtaccgcgcggtcatcgccgagttcgtggccacgctgctcttcctctacatcaccgtggccactgtcatcgggtacaagcaccaggcggaccccgccggccccaatgctgccgacgcggcctgcagcggcgtcggcatcctcggcatcgcctgggcgttcggcggcatgatcttcgtgctcgtctactgcactgccggggtttccggtggccacatcaacccggcggtgacgttcgggctgttcctggcgcggaaggtgtcgctggtgcgcgcgctgctctacatcatcgcgcagtgcctgggcgccatctgcggcgtcgggctcgtcaaggggttccagagcgccttctacgtgcgctacggcggcggcgccaacgagctcagctccggcttctccaagggcaccggcctcgccgccgagatcatcggcaccttcgtgctcgtctacaccgtcttctccgccaccgaccccaagcgcagcgcccgtgactcccacgtcccggtgctggctcctctgccaatcggcttcgcggtgttcatggtgcacctggccactatcccgatcaccggcaccggcatcaacccggcaaggagctttggagctgccgtgatctacaacaacgagaaggcctgggatgaccactggatcttctgggtggggccattcatcggggccgccatcgccgccgcctaccaccagtacgtcctgagggccagcgccaccaagctcggctcgtctgcctccttcggcaggaactagatcggccgactgcagtatggatgatcggaagcacggacagtagatatatcagtgtgatactgttcgggtgatgtattgtgcacgcgtctgtattttcttagacgcgtttgggtgtcttcaaaatttctctacaattgcactaaattcgaaggactcgtcaccatgtgttttttttgaacaaacaaagggtacggaaggacctagaagttgcattaactaggaagaagtggatcacattgttttacaacaggacactaaaagaaaaatgaaacaacaaactagtgcctagttactaaaaaaaaaaaaaaaa

SEQ ID NO: 8199 - protein, 290 aa, Glycine max
  misc_feature (1)..(290): Ceres CLONE ID NO.1020667
  misc_feature (32)..(270): Pfam Name: MIP Pfam Description: Major intrinsic protein
  misc_feature (1)..(290): Functional Homolog of  Ceres CLONE NO.33231 with e-value of 4.89E-120 and BLAST sequence identity of 80.6
  misc_feature (1)..(290): useful for making plants with altered flowering time as described in USSN 12/281,616
MAKDIEAAPPGGEYGAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGFSKGTGLAAEIIGTFVLVYTVFSATDPKRSARDSHVPVLAPLPIGFAVFMVHLATIPITGTGINPARSFGAAVIYNNEKAWDDHWIFWVGPFIGAAIAAAYHQYVLRASATKLGSSASFGRN

SEQ ID NO: 8200 - DNA, 1332 bp, Glycine max
  misc_feature (1)..(1332): Ceres CLONE ID no.1368057
  misc_feature (1)..(1332): useful for making plants with altered flowering time as described in USSN 12/281,616
ccccaccacacaccccaagcccccacctccattttttccagccaggtttgcagcgagaaggaacagcaaggctagctacacaagccgatggccaaggacgaggtgatggagaccggcggcggcggcgacttcgcggccaaggactacacggacccgccgccggccccgctgatcgacgcggccgagctggcctcctggtcgctctaccgcgccgtcatcgccgagttcatcgccacgctgctcttcctctacatcaccgtggccaccgtcatcgggtacaagcaccagacggacccggcggtgaacagcgccgccgacgcagcgtgcggcggcgtgggcgtgctcggcatcgcctgggccttcggcggcatgatcttcgtcctcgtctactgcaccgccggcatctccgggggccacatcaacccggccgtcaccttcggcctcttcctggcgcgcaaggtgtccctggtccgcgcgctgctctacatgattgcgcagtgcctcggcgccatgtgcggggtcggcctcgtcaagaccttccagagcgcctacttcgtcaggtacggcggcggcgccaacacgctcgccgccggctactccaagggcaccggcctcgctgcggagatcatcggcaccttcgtgctcgtctacaccgtcttctccgccaccgaccccaagcgcagcgcacgcgactctcacgtcccggtgctggcgcccctcccgatcggcttcgccgtgttcatggtccacctggccaccatccccatcaccgtcaccggcatcaacccggcccggagcctgggggccgccgtcatctacaacaaggacaaggcctgggatgatcagtggatcttctgggtcggccccatgatcggcgcggcgatcgcggccttctaccaccagtacatcctcagggccggcgccatcaaggccctcggctccttcaggagcaacgcgtaacaagttatcatccatgtcatctgtatgcaagactgaagcaatggcgacccgtgttgtgtccatccatccagagagaaatgcgcttttgcaacttctcgacagttcagttcggccgccgcaatggtcgtgttattatgtgtcggcagctgcatatgcgtagtacgtggtccggtcatgcgtgccgtgtcttgtaattcggtccatgggatcgcttgtcttaattagcccgcattgcttttcctacttgtatttaaatttagcgaccatatgtatgatcgatccaacgtcgccacctttctatctaagtcatcaatccaccaagcaagtgatcatcccaaaaaaaaaaaaaaaaaaagaaaaaaaaaaaaaaaa

SEQ ID NO: 8201 - protein, 290 aa, Glycine max
  misc_feature (1)..(290): Ceres CLONE ID NO.1368057
  misc_feature (33)..(271): Pfam Name: MIP Pfam Description: Major intrinsic protein
  misc_feature (1)..(290): Functional Homolog of  Ceres CLONE NO.33231 with e-value of 2.10E-119 and BLAST sequence identity of 80.5
  misc_feature (1)..(290): useful for making plants with altered flowering time as described in USSN 12/281,616
MAKDEVMETGGGGDFAAKDYTDPPPAPLIDAAELASWSLYRAVIAEFIATLLFLYITVATVIGYKHQTDPAVNSAADAACGGVGVLGIAWAFGGMIFVLVYCTAGISGGHINPAVTFGLFLARKVSLVRALLYMIAQCLGAMCGVGLVKTFQSAYFVRYGGGANTLAAGYSKGTGLAAEIIGTFVLVYTVFSATDPKRSARDSHVPVLAPLPIGFAVFMVHLATIPITVTGINPARSLGAAVIYNKDKAWDDQWIFWVGPMIGAAIAAFYHQYILRAGAIKALGSFRSNA

SEQ ID NO: 8202 - DNA, 855 bp, Populus balsamifera subsp. trichocarpa
  misc_feature (1)..(855): Ceres ANNOT ID no.1515353
  misc_feature (1)..(855): useful for making plants with altered flowering time as described in USSN 12/281,616
atggcgaaggatattgaggttgcagagcatggagagactgtgaaggactaccaggacccacctccagctccattgattgatgctgaggagctaggacaatggtccttttacagggctcttattgcagaattcatcgccacccttctcttcctttatgtcacagtcttgactgttattggatacaaaagccagacagacccagacaagggtctggatgcttgtggtggtgttggcattcttggtattgcttgggccttcggtggcatgatctttgtccttgtttactgcactgctggtatctctggaggacacatcaacccagcagtgacctttggtctgtttctggcgaggaaggtgtcgctcatcagggctgttttgtacatggtggcacagtgcttgggtgcgatatgcggctgtggtttggtgaaggccttccaaaagtcttattacaatcactatggaggcggagccaacgagctgcaggaagggtacaacaagggcactggattgggtgctgaaatcatcggtacttttgttcttgtctacactgtcttctccgccactgatcccaagaggaatgctagagactcccatgttcctgtattggcacctctccccattggatttgctgtgttcatggttcacctcgccacaatcccaattactggtactggcatcaaccctgctaggagcttcggagctgctgttatctttaaccaaagcaaggcctgggatgaccattggctcttctgggttggacccttcattggagctgccattgctgctttctaccaccagttcattcttagagcagcggctattaaggctctaggatccttcaggagcaatgcttaa

SEQ ID NO: 8203 - protein, 284 aa, Populus balsamifera subsp. trichocarpa
  misc_feature (1)..(284): Ceres ANNOT ID NO.1515353
  misc_feature (30)..(265): Pfam Name: MIP Pfam Description: Major intrinsic protein
  misc_feature (1)..(284): Functional Homolog of  Ceres CLONE NO.33231 with e-value of 2.20E-126 and BLAST sequence identity of 84.0
  misc_feature (1)..(284): useful for making plants with altered flowering time as described in USSN 12/281,616
MAKDIEVAEHGETVKDYQDPPPAPLIDAEELGQWSFYRALIAEFIATLLFLYVTVLTVIGYKSQTDPDKGLDACGGVGILGIAWAFGGMIFVLVYCTAGISGGHINPAVTFGLFLARKVSLIRAVLYMVAQCLGAICGCGLVKAFQKSYYNHYGGGANELQEGYNKGTGLGAEIIGTFVLVYTVFSATDPKRNARDSHVPVLAPLPIGFAVFMVHLATIPITGTGINPARSFGAAVIFNQSKAWDDHWLFWVGPFIGAAIAAFYHQFILRAAAIKALGSFRSNA

SEQ ID NO: 8204 - DNA, 1098 bp, Zea mays
  misc_feature (1)..(1098): Ceres CLONE ID no.1445059
  misc_feature (1)..(1098): useful for making plants with altered flowering time as described in USSN 12/281,616
accacagagagctaagcgcattcgcatcttgagcacagacacccaccctagcttgtcgatcagtcgaggcagcgacgatggccaaggacatcgaggcggcgccccccggaggggagtacggagccaaggactactctgacccgccgccggcgccgctcttcgacgccgaggagctgactaaatggtccctgtaccgcgcggtcatcgccgagttcgtggccacgctgctcttcctctacatcaccgtggccactgtcatcgggtacaagcaccaggcggaccccgccggccccaatgctgccgacgcggcctgcagcggcgtcggcatcctcggcatcgcctgggcgttcggcggcatgatcttcgtgctcgtctactgcactgccggggtttccggtggccacatcaacccggcggtgacgttcgggctgttcctggcgcggaaggtgtcgctggtgcgcgcgctgctctacatcatcgcgcagtgcctgggcgccatctgcggcgtcgggctcgtcaaggggttccagagcgccttctacgtgcgctacggcggcggcgccaacgagctcagctccggcttctccaagggcaccggcctcgccgccgagatcatcggcaccttcgtgctcgtctacaccgtcttctccgccaccgaccccaagcgcagcgcccgtgactcccacgtcccggtgctggctcctctgccaatcggcttcgcggtgttcatggtgcacctggccactatcccgatcaccggcaccggcatcaacccggcaaggagctttggagctgccgtgatctacaacaacgagaaggcctgggatgaccactggatcttctgggtggggccattcatcggggccgccatcgccgccgcctaccaccagtacgtcctgagggccagcgccaccaagctcggctcgtctgcctccttcggcaggaactagatcggccgactgcagtatggatgatcggaagcacggacagtagatatatcagtgtgatactgttcgggtgatgtattgtgcacgcgtctgtattttcttagacgcgtttgggtgtcttcaaaatttctctacaaaaaaaaaaaaaaaa

SEQ ID NO: 8205 - protein, 290 aa, Zea mays; identical to SEQ ID NO: 8199
  misc_feature (1)..(290): Ceres CLONE ID NO.1445059
  misc_feature (32)..(270): Pfam Name: MIP Pfam Description: Major intrinsic protein
  misc_feature (1)..(290): Functional Homolog of  Ceres CLONE NO.33231 with e-value of 4.89E-120 and BLAST sequence identity of 80.6
  misc_feature (1)..(290): useful for making plants with altered flowering time as described in USSN 12/281,616

SEQ ID NO: 8206 - DNA, 440 bp, Brassica napus
  misc_feature (1)..(440): Ceres CLONE ID no.1095849
  misc_feature (1)..(440): useful for making plants with altered flowering time as described in USSN 12/281,616
atcataataaccaaaaacacatttttcctaaatagaaatatattaaatggctaaagatgtggaaggagcagagggagtcacggcgagggactacgaagacccaccgcctactccgtttttcgatgcggaggagctcacgaagtggtctttatacagagcagtcatcgccgagttcgtagccactctcctcttcttatatgtcaccgttttgactgtcatcggctacaagatttcctccgacactaaggcaggaggcgacgactgcggaggcgtcggaatcctcggtatctcgtgggctttcggcggcatgatcttcatccttgtctactgcaccgccggtatctcaggtggtcacataaacccggcggtgacgttcggcttattcttggcccggaaggtatcgctggttagagcggttctatacatggtggctcagtgtt

SEQ ID NO: 8207 - protein, 283 aa, Brassica napus
  misc_feature (1)..(283): Ceres CLONE ID NO.1095849
  misc_feature (29)..(264): Pfam Name: MIP Pfam Description: Major intrinsic protein
  misc_feature (1)..(283): Functional Homolog of  Ceres CLONE NO.33231 with e-value of 5.30E-52 and BLAST sequence identity of 80.9
  misc_feature (1)..(283): useful for making plants with altered flowering time as described in USSN 12/281,616
MAKDVEGAEGVTARDYEDPPPTPFFDAEELTKWSLYRAVIAEFVATLLFLYVTVLTVIGYKISSDTKAGGDDCGGVGILGISWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 8208 - DNA, 1202 bp, Zea mays
  misc_feature (1)..(1202): Ceres CLONE ID no.1390684
  misc_feature (1)..(1202): useful for making plants with altered flowering time as described in USSN 12/281,616
acaaatcaagagctaactctatataaagaaccatttgctctagcttattctcacaaccggaagcaaaagtaaaacagttcctaagaagaaacatccattacatataataatactacatggctaaagacgtggaaggagcagaggggttcgcggcgagggactacgaagatccgccgccaacaccgttcttcgatgcggaggagctgaccaagtggtctttgtacagagccgtcatagccgagttcgtagccactctcctcttcttgtatgtcactgttttgactgtcatcggctacaagatttcgtccgacactaaggccggaggcgacgagtgcggaggcgtcggaatccttggcatctcatgggccttcggcggcatgatcttcatccttgtctactgcaccgccggtatctcaggtggtcacataaaccctgcggtgacgttcggcttgttcttggcaaggaaggtatcgttggttagagcggtgctatacatggtggctcagtgtttgggtgcgatttgtggagttggtttcgtcaaagccttccaaagctcttactacgtccgttacggtggaggagcaaactctctagccgatggatacagcacagggactggactcgctgcagagatcattggaacattcgtcctggtctacactgttttctccgccactgaccccaaaagaaacgcacgagactcccacgttcccgtgttggcgccactcccaattggatttgccgtgttcatggtacacttggccactattccaatcaccggaaccggtattaacccggccaggagtttcggagctgcggtgatctacaacgagtccaagccgtgggatgaccactggatattctgggtgggaccattcatcggagctgccatagctgcattttatcaccaattcgttctaagggcctctggttccaaatccctcggatccttcagaagtgcagccaacgtttgagtttagccacacaaaacaaaacaaaaaaagtggttactgttatgtataaattgggcacgtgattttaaaatgtgtcctcttatgtcttttcttttcatctgcttctatttgtgtgaattccaattattgaagttttagtgttttgcgtgttttcatcatggcaatgtcagtgagtttgtttattgagaaaaagccgaccacattgtttcgcgaaaaaaaaaaaaaaaa

SEQ ID NO: 8209 - protein, 285 aa, Zea mays
  misc_feature (1)..(285): Ceres CLONE ID NO.1390684
  misc_feature (29)..(264): Pfam Name: MIP Pfam Description: Major intrinsic protein
  misc_feature (1)..(285): Functional Homolog of  Ceres CLONE NO.33231 with e-value of 4.50E-126 and BLAST sequence identity of 84.6
  misc_feature (1)..(285): useful for making plants with altered flowering time as described in USSN 12/281,616
MAKDVEGAEGFAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 8210 - protein, 285 aa, Arabidopsis thaliana
  misc_feature (1)..(285): Public GI ID NO.472879
  misc_feature (29)..(264): Pfam Name: MIP Pfam Description: Major intrinsic protein
  misc_feature (29)..(264): Pfam Name: MIP Pfam Description: Major intrinsic protein
  misc_feature (1)..(285): Functional Homolog of  Ceres CLONE NO.33231 with e-value of 2.49E-125 and BLAST sequence identity of 84.2
  misc_feature (1)..(285): useful for making plants with altered flowering time as described in USSN 12/281,616
MAKDVEGPEGFQTRDYEDPPPTPFFDADELTKWSLYRAVIAEFVATLLFLYITVLTVIGYKIQSDTKAGGVDCGGVGILGIAWAFGGMIFILVYCTAGISGGHINPAVTFGLFLARKVSLIRAVLYMVAQCLGAICGVGFRQSFQSSYYDRYGGGANSLADGYNTGTGLAAEIIGTFVLVYTVFSATDPKRNARDSHVPVLAPLPIGFAVFMVHLATIPITGTGINPARSFGASVIYNKSKPWDDHWIFWVGPFIGAAIAAFYHQFVLRASGSKSLGSFRSAANV

SEQ ID NO: 8211 - protein, 287 aa, Mesembryanthemum crystallinum
  misc_feature (1)..(287): Public GI ID NO.1657948
  misc_feature (33)..(268): Pfam Name: MIP Pfam Description: Major intrinsic protein
  misc_feature (1)..(287): Functional Homolog of  Ceres CLONE NO.33231 with e-value of 9.99E-127 and BLAST sequence identity of 83.0
  misc_feature (1)..(287): useful for making plants with altered flowering time as described in USSN 12/281,616
MTKDVEVAEQQAPEFSAKDYHDPPPAPLIDFEELRKWSFYRAVIAEFIATLLFLYITVLTVIGYKSQTDPNTNADQCGGVGILGIAWAFGGMIFILVYCTAGISGGHINPAVTFGLFLARKVSLIKAVLYMVAQCLGAICGVGFVKAFQKAYYVRYGGGANEMASGYTKGTGLGAEIIGTFVLVYTVFAATDPKRNARDSHVPVLAPLPIGFAVFMVHLATIPITGTGINPARSFGAAVIYNQQKAWDDHWIFWVGPFIGAAIAAFYHQYILRAAAIKALGSFRSSA

SEQ ID NO: 8212 - protein, 290 aa, Oryza sativa
  misc_feature (1)..(290): Public GI ID NO.3135543
  misc_feature (34)..(271): Pfam Name: MIP Pfam Description: Major intrinsic protein
  misc_feature (1)..(290): Functional Homolog of  Ceres CLONE NO.33231 with e-value of 3.00E-120 and BLAST sequence identity of 81.5
  misc_feature (1)..(290): useful for making plants with altered flowering time as described in USSN 12/281,616
MGKDEVMESGGAAGEFAAKDYTDPPPAPLIDAAELGSWSLYRAVIAEFIATLLFLYITVATVIGYKHQTDASASGADAACGGVGVLGISWAFGGMIFILVYCTAGISGGHINPAVTFGLFLARKVSLVRAILYIVAQCLGAICGVGLVNAFPNAYFNRYGGGANTLAAGYSKGTGLAAEIIGTFVLVYTVFSATDPKRNARDSHVPVLAPLPIGFAVFMVHLATIPITGTGINPARSIGAAVIFNNEKAWHNHWIFWVGPFVGAAIAAFYHQYILRAGAIKALGSFRSNA

SEQ ID NO: 8213 - protein, 287 aa, Samanea saman
  misc_feature (1)..(287): Public GI ID NO.3158476
  misc_feature (31)..(266): Pfam Name: MIP Pfam Description: Major intrinsic protein
  misc_feature (1)..(287): Functional Homolog of  Ceres CLONE NO.33231 with e-value of 8.40E-125 and BLAST sequence identity of 81.2
  misc_feature (1)..(287): useful for making plants with altered flowering time as described in USSN 12/281,616
MAKDVEVAERGSYSAKDYHDPPPAPLIDAEELGKWSFYRALIAEFIATLLFLYITVLTVIGYKSQSDTKAGGDVCGGVGILGIAWAFGGMIFILVYCTAGISGGHINPAVTFGLFLARKVSLIRAILYMVAQCLGAICGVGLVKAFQKAYYSRYGGGANTLSDGYSTGTGLGAEIIGTFVLVYTVFSATDPKRSARDSHVPVLAPLPIGFAVFMVHLATIPVTGTGINPARSLGAAVIFNQQKAWDDHWIFWVGPFIGAAIAAFYHQFILRAGAAKALGSFRSNPSV

SEQ ID NO: 8214 - protein, 287 aa, Raphanus sativus
  misc_feature (1)..(287): Public GI ID NO.3551133
  misc_feature (31)..(266): Pfam Name: MIP Pfam Description: Major intrinsic protein
  misc_feature (31)..(266): Pfam Name: MIP Pfam Description: Major intrinsic protein
  misc_feature (1)..(287): Functional Homolog of  Ceres CLONE NO.33231 with e-value of 1.99E-125 and BLAST sequence identity of 82.3
  misc_feature (1)..(287): useful for making plants with altered flowering time as described in USSN 12/281,616
MAKDVEAVSGEGFQTRDYQDPPPAPLFDPEELTKWSFYRAVIAEFVATLLFLYITVLTVIGYKIETDSTAGGVDCGGVGILGIAWAFGGMIFILVYCTAGISGGHINPAVTFGLLLARKVSLVRAILYMVAQCLGAICGVGFVKAFQSAYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFIGAAIAAFYHQFVLRASGSKSLGSFRSAANV

SEQ ID NO: 8215 - protein, 285 aa, Arabidopsis thaliana
  misc_feature (1)..(285): Public GI ID NO.4371284
  misc_feature (29)..(264): Pfam Name: MIP Pfam Description: Major intrinsic protein
  misc_feature (29)..(264): Pfam Name: MIP Pfam Description: Major intrinsic protein
  misc_feature (1)..(285): Functional Homolog of  Ceres CLONE NO.33231 and BLAST sequence identity of 85.7
  misc_feature (1)..(285): useful for making plants with altered flowering time as described in USSN 12/281,616
MAKDVEGPEGFQTRDYEDPPPTPFFDADELTKWSLYRAVIAEFVATLLFLYITVLTVIGYKIQSDTKAGGVDCGGVGILGIAWAFGGMIFILVYCTAGISGGHINPAVTFGLFLARKVSLIRAVLYMVAQCLGAICGVGFVKAFQSSYYDRYGGGANSLADGYNTGTGLAAEIIGTFVLVYTVFSATDPKRNARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 8216 - protein, 285 aa, Zea mays
  misc_feature (1)..(285): Public GI ID NO.4741931
  misc_feature (29)..(266): Pfam Name: MIP Pfam Description: Major intrinsic protein
  misc_feature (1)..(285): Functional Homolog of  Ceres CLONE NO.33231 with e-value of 9.00E-121 and BLAST sequence identity of 81.4
  misc_feature (1)..(285): useful for making plants with altered flowering time as described in USSN 12/281,616
MAKDIEAAAAHEGKDYSDPPPAPLVDAEELTKWSLYRAVIAEFVATLLFLYITVATVIGYKHQTDAAASGPDAACGGVGVLGIAWAFGGMIFILVYCTAGVSGGHINPAVTFGLFLARKVSLVRALLYIVAQCLGAICGVGLVKGFQSAFYVRYGGGANELSAGYSKGTGLAAEIIGTFVLVYTVFSATDPKRNARDSHVPVLAPLPIGFAVFMVHLATIPITGTGINPARSLGAAVIYNNDKAWDDHWIFWVGPFIGAAIAAAYHQYVLRASAAKLGSSASFSR

SEQ ID NO: 8217 - protein, 291 aa, Mesembryanthemum crystallinum
  misc_feature (1)..(291): Public GI ID NO.4884864
  misc_feature (32)..(269): Pfam Name: MIP Pfam Description: Major intrinsic protein
  misc_feature (1)..(291): Functional Homolog of  Ceres CLONE NO.33231 with e-value of 3.80E-122 and BLAST sequence identity of 80.5
  misc_feature (1)..(291): useful for making plants with altered flowering time as described in USSN 12/281,616
MAKDFETGGGEVRDVAKDYQDPPPSPLFDMEELTKWSFYRALIAEFIATLLFLYITVLTVIGYKHQSDPLVSGADAGCGGVGILGIAWAFGGMIFILVYCTAGISGGHINPAVTFGLFLARKLSLIRAIMYMVAQCLGAICGVGFVKAFQSAYYNKYGGGANELSVGYSKGTGLAAEIIGTFVLVYTVFSATDPKRSARDSHVPVLAPLPIGFAVFMVHLATIPITGTGINPARSLGAAVIYNNNKAWDDQWIFWVGPFIGAAIAAIYHQYILRAGFIKALGSFRSSTSNV

SEQ ID NO: 8218 - protein, 287 aa, Brassica napus
  misc_feature (1)..(287): Public GI ID NO.5081421
  misc_feature (31)..(266): Pfam Name: MIP Pfam Description: Major intrinsic protein
  misc_feature (31)..(266): Pfam Name: MIP Pfam Description: Major intrinsic protein
  misc_feature (1)..(287): Functional Homolog of  Ceres CLONE NO.33231 with e-value of 2.49E-125 and BLAST sequence identity of 82.3
  misc_feature (1)..(287): useful for making plants with altered flowering time as described in USSN 12/281,616
MAKDVEAVSGEGFQTRDYQDPPPAPLFDPAELTKWSFYRAVIAEFVATLLFLYITVLTVIGYKIQTDSTAGGVDCGGVGILGIAWAFGGMIFILVYCTAGISGGHINPAVTFGLLLARKVSLVRAILYMVAQCLGAICGVGFVKAFQSSYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFVGAAIAAFYHQFVLRASGSKSLGSFRSAANV

SEQ ID NO: 8219 - protein, 283 aa, Brassica napus; identical to SEQ ID NO: 8207
  misc_feature (1)..(283): Public GI ID NO.5081423
  misc_feature (29)..(264): Pfam Name: MIP Pfam Description: Major intrinsic protein
  misc_feature (1)..(283): Functional Homolog of  Ceres CLONE NO.33231 with e-value of 7.39E-126 and BLAST sequence identity of 84.3
  misc_feature (1)..(283): useful for making plants with altered flowering time as described in USSN 12/281,616

SEQ ID NO: 8220 - protein, 283 aa, Raphanus sativus
  misc_feature (1)..(283): Public GI ID NO.7209560
  misc_feature (29)..(264): Pfam Name: MIP Pfam Description: Major intrinsic protein
  misc_feature (1)..(283): Functional Homolog of  Ceres CLONE NO.33231 with e-value of 3.20E-125 and BLAST sequence identity of 83.9
  misc_feature (1)..(283): useful for making plants with altered flowering time as described in USSN 12/281,616
MAKEVEGAEGFATRDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 8221 - protein, 283 aa, Raphanus sativus
  misc_feature (1)..(283): Public GI ID NO.7209562
  misc_feature (29)..(264): Pfam Name: MIP Pfam Description: Major intrinsic protein
  misc_feature (1)..(283): Functional Homolog of  Ceres CLONE NO.33231 with e-value of 1.19E-125 and BLAST sequence identity of 83.9
  misc_feature (1)..(283): useful for making plants with altered flowering time as described in USSN 12/281,616
MAKDVEGAEGVTARDYEDPPPTPFFDAEELTKWSLYRAVIAEFVATLLFLYITVLTVIGYKISSDTKAGGDECGGVGILGIAWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 8222 - protein, 291 aa, Allium cepa
  misc_feature (1)..(291): Public GI ID NO.7649310
  misc_feature (34)..(272): Pfam Name: MIP Pfam Description: Major intrinsic protein
  misc_feature (1)..(291): Functional Homolog of  Ceres CLONE NO.33231 with e-value of 1.30E-121 and BLAST sequence identity of 81.8
  misc_feature (1)..(291): useful for making plants with altered flowering time as described in USSN 12/281,616
MANKEVDVPETKDTQFTAKDYTDPPPAPLFDMGELTKWSLYRAVIAEFVATLLFLYITVATVIGYSHQSDATIPGNTDAHCSGVGVLGIAWAFGGMIFVLVYCTAGISGGHINPAVTFGLFLARKVSLIRALLYMIAQCLGAICGVGFVKAFQSAYYSRYGGGANTLNAGYSKGTGLAAEIIGTFVLVYTVFAATDPKRSARDSHVPVLAPLPIGFAVFMVHLATIPITGTGINPARSFGAAVIYNKDKAWDDQWIFWVGPFIGAAIAAAYHQYVLRAGAVKALGSFGSNA

SEQ ID NO: 8223 - protein, 284 aa, Vitis berlandieri x Vitis rupestris
  misc_feature (1)..(284): Public GI ID NO.8071620
  misc_feature (31)..(263): Pfam Name: MIP Pfam Description: Major intrinsic protein
  misc_feature (1)..(284): Functional Homolog of  Ceres CLONE NO.33231 with e-value of 5.80E-126 and BLAST sequence identity of 84.2
  misc_feature (1)..(284): useful for making plants with altered flowering time as described in USSN 12/281,616
MTKDVEVAEHGSFSAKDYHDPPPAPLFDSVELTKWSFYRALIAEFIATLLFLYITVLTVIGYKSQTAGGDPCGGVGILGIAWSFGGMIFILVYCTAGISGGHINPAVTFGLFLARKVSLIRAILYMVAQCLGAICGVGLVKAFQSAYYDRYGGGANELSTGYSKGTGLGAEIIGTFVLVYTVFSATDPKRSARDSHVPVLAPLPIGFAVFMVHLATIPITGTGINPARSLGAAVIYNNEKAWDDQWIFWVGPFIGAAIAAFYHQFILRAGAIKALGSFRSTPRV

SEQ ID NO: 8224 - protein, 290 aa, Zea mays; identical to SEQ ID NO: 8191
  misc_feature (1)..(290): Public GI ID NO.13447801
  misc_feature (34)..(271): Pfam Name: MIP Pfam Description: Major intrinsic protein
  misc_feature (1)..(290): Functional Homolog of  Ceres CLONE NO.33231 with e-value of 4.20E-123 and BLAST sequence identity of 83.3
  misc_feature (1)..(290): useful for making plants with altered flowering time as described in USSN 12/281,616

SEQ ID NO: 8225 - protein, 292 aa, Zea mays
  misc_feature (1)..(292): Public GI ID NO.13447803
  misc_feature (34)..(273): Pfam Name: MIP Pfam Description: Major intrinsic protein
  misc_feature (1)..(292): Functional Homolog of  Ceres CLONE NO.33231 with e-value of 2.39E-120 and BLAST sequence identity of 81.2
  misc_feature (1)..(292): useful for making plants with altered flowering time as described in USSN 12/281,616
MGKDDVVQSGAGGGEFAAKDYTDPPPAPLVDAAELGSWSLYRAVIAEFIATLLFLYVTVATVIGYKHQTDASASGAGADAACGGVGVLGIAWAFGGMIFVLVYCTAGISGGHINPAVTFGLFLARKVSLVRALLYMVAQCLGAVCGVGLVKAFQSAYFDRYGGGANSLASGYSRGAGLGAEIVGTFVLVYTVFSATDPKRNARDSHVPVLAPLPIGFAVFMVHLATIPVTGTGINPARSLGAAVVYNKDKPWDDHWIFWVGPLLGAAIAAFYHQYILRAGAIKALGSFRSNA

SEQ ID NO: 8226 - protein, 289 aa, Zea mays
  misc_feature (1)..(289): Public GI ID NO.13447805
  misc_feature (34)..(271): Pfam Name: MIP Pfam Description: Major intrinsic protein
  misc_feature (1)..(289): Functional Homolog of  Ceres CLONE NO.33231 with e-value of 2.90E-122 and BLAST sequence identity of 82.9
  misc_feature (1)..(289): useful for making plants with altered flowering time as described in USSN 12/281,616
MAKQDIEASGPEAGEFSAKDYTDPPPAPLIDADELTKWSLYRAVIAEFIATLLFLYITVATVIGYKHQTDAAASGPDAACGGVGILGIAWAFGGMIFILVYCTAGISGGHINPAVTFGLFLARKVSLVRALLYIIAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 8227 - protein, 288 aa, Zea mays
  misc_feature (1)..(288): Public GI ID NO.13447807
  misc_feature (33)..(270): Pfam Name: MIP Pfam Description: Major intrinsic protein
  misc_feature (1)..(288): Functional Homolog of  Ceres CLONE NO.33231 with e-value of 1.10E-122 and BLAST sequence identity of 81.9
  misc_feature (1)..(288): useful for making plants with altered flowering time as described in USSN 12/281,616
MAKDIEASGPEAGEFSAKDYTDPPPAPLIDAEELTQWSLYRAVIAEFIATLLFLYITVATVIGYKHQTDASASGPDAACGGVGILGIAWAFGGMIFILVYCTAGISGGHINPAVTFGLFLARKVSLVRALLYIIAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 8228 - protein, 281 aa, Pyrus communis
  misc_feature (1)..(281): Public GI ID NO.13486938
  misc_feature (31)..(262): Pfam Name: MIP Pfam Description: Major intrinsic protein
  misc_feature (1)..(281): Functional Homolog of  Ceres CLONE NO.33231 with e-value of 5.20E-125 and BLAST sequence identity of 83.8
  misc_feature (1)..(281): useful for making plants with altered flowering time as described in USSN 12/281,616
MAKDVEVAEHGEFAAKDYHDPPPTPLFDAEELTKWSFYRALIAEFIATLLFLYITVLTVIGYKSQSEADQCGGVGILGIAWAFGGMIFVLVYCTAGISGGHINPAVTFGLFLARKVSLIRAVLYIIAQCLGAICGVGLVKAFQKSYYVKYGGGANELSAGYNKGTGLGAEIIGTFVLVYTVFSATDPKRNARDSHVPVLAPLPIGFAVFIVHLATIPITGTGINPARSLGAAVIYNKDKAWDDQWIFWLGPFIGAAIAAFYHQYILRAGAIKALGSFRSNA

SEQ ID NO: 8229 - protein, 287 aa, Pyrus communis
  misc_feature (1)..(287): Public GI ID NO.13486942
  misc_feature (31)..(266): Pfam Name: MIP Pfam Description: Major intrinsic protein
  misc_feature (1)..(287): Functional Homolog of  Ceres CLONE NO.33231 with e-value of 9.00E-121 and BLAST sequence identity of 80.9
  misc_feature (1)..(287): useful for making plants with altered flowering time as described in USSN 12/281,616
MAKDMEVAERGSFSAKDYHDPPPAPLIDAAELTKWSFYRALIAEFVATLLFLYVTVLTVIGYKSQTDPAVNADACGGVGILGIAWAFGGMIFVLVYCTAGISGGHINPAVTFGLFLARKVSLVRAVLYMVAQSLGAIAGVALVKAFQKSYYIKYGGGANSLSDGYSTGVGLAAEIIGTFVLVYTVFSATDPKRSARDSHVPVLAPLPIGFAVFIVHLATIPITGTGINPARSLGAAVIYNKDKAWDDQWIFWVGPFIGAAIAAFYHQFILRAGAVKALGSFRSNPHV

SEQ ID NO: 8230 - protein, 285 aa, Arabidopsis thaliana
  misc_feature (1)..(285): Public GI ID NO.20465733
  misc_feature (29)..(264): Pfam Name: MIP Pfam Description: Major intrinsic protein
  misc_feature (1)..(285): Functional Homolog of  Ceres CLONE NO.33231 and BLAST Sequence identity of 83.6
  misc_feature (1)..(285): useful for making plants with altered flowering time as described in USSN 12/281,616
MAKDVEGPDGFQTRDYEDPPPTPFFDAEELTKWSLYRAVIAEFVATLLFLYVTVLTVIGYKIQSDTKAGGVDCGGVGILGIAWAFGGMIFILVYCTAGISGGHINPAVTFGLFLARKVSLIRAVLYMVAQCLGAICGVGFVKAFQSSHYVNYGGGANFLADGYNTGTGLAAEIIGTFVLVYTVFSATDPKRNARDSHVPVLAPLPIGFAVFMVHLATIPITGTGINPARSFGAAVIFNKSKPWDDHWIFWVGPFIGATIAAFYHQFVLRASGSKSLGSFRSAANV

SEQ ID NO: 8231 - protein, 285 aa, Arabidopsis thaliana; identical to SEQ ID NO: 8189
  misc_feature (1)..(285): Public GI ID NO.21537097
  misc_feature (29)..(264): Pfam Name: MIP Pfam Description: Major intrinsic protein
  misc_feature (1)..(285): Functional Homolog of  Ceres CLONE NO.33231 with e-value of 2.49E-125 and BLAST sequence identity of 83.6
  misc_feature (1)..(285): useful for making plants with altered flowering time as described in USSN 12/281,616

SEQ ID NO: 8232 - protein, 285 aa, Arabidopsis thaliana; identical to SEQ ID NO: 7223
  misc_feature (1)..(285): Public GI ID NO.21554356
  misc_feature (29)..(264): Pfam Name: MIP Pfam Description: Major intrinsic protein
  misc_feature (29)..(264): Pfam Name: MIP Pfam Description: Major intrinsic protein
  misc_feature (1)..(285): Functional Homolog of  Ceres CLONE NO.33231 with e-value of 9.99E-127 and BLAST sequence identity of 85.3
  misc_feature (1)..(285): useful for making plants with altered flowering time as described in USSN 12/281,616

SEQ ID NO: 8233 - protein, 287 aa, Juglans regia
  misc_feature (1)..(287): Public GI ID NO.28395418
  misc_feature (31)..(266): Pfam Name: MIP Pfam Description: Major intrinsic protein
  misc_feature (1)..(287): Functional Homolog of  Ceres CLONE NO.33231 with e-value of 9.39E-126 and BLAST sequence identity of 81.6
  misc_feature (1)..(287): useful for making plants with altered flowering time as described in USSN 12/281,616
MAKDIEAAGQGGFSAKDYHDPPPAPLIDAEEFTQWSFYRAIIAEFIATLLFLYITVLTVIGYKSQTDKAKGGDDCGGVGILGIAWAFGGMIFVLVYCTAGISGGHINPAVTFGLFLARKVSLVRAVFYMAAQCLGAVCGCGLVKAFQKAYYSKYGGGANELADGYSKGTGLAAEIIGTFVLVYTVFSATDPKRNARDSHVPVLAPLPIGFAVFMVHLATIPITGTGINPARSFGAAVIYGKDKAWNDQWIFWVGPFIGAAIAAFYHQYILRAGAAKALGSFRSSSTI

SEQ ID NO: 8234 - protein, 287 aa, Juglans regia
  misc_feature (1)..(287): Public GI ID NO.28395420
  misc_feature (31)..(266): Pfam Name: MIP Pfam Description: Major intrinsic protein
  misc_feature (1)..(287): Functional Homolog of  Ceres CLONE NO.33231 with e-value of 9.99E-127 and BLAST sequence identity of 82.3
  misc_feature (1)..(287): useful for making plants with altered flowering time as described in USSN 12/281,616
MAKDIEAAGQGGFSAKDYHDPPPAPLIDAEEFTQWSFYRAIIAEFIATLLFLYITVLTVIGYKSQTDKAKGGDDCGGVGILGIAWAFGGMIFVLVYCTAGISGGHINPAVTFGLFLARKVSLVRAVFYMAAQCLGAVCGCGLVKAFQKAYYSKYGGGANELADGYSKGTGLAAEIIGTFVLVYTVFSATDPKRNARDSHVPVLAPLPIGFAVFMVHLATIPITGTGINPARSFGAAVIYGKDKAWDDQWIFWVGPFIGAAIAAFYHQYILRAAAAKALGSFRSSSHM

SEQ ID NO: 8235 - protein, 290 aa, Zea mays
  misc_feature (1)..(290): Public GI ID NO.29650727
  misc_feature (34)..(271): Pfam Name: MIP Pfam Description: Major intrinsic protein
  misc_feature (1)..(290): Functional Homolog of  Ceres CLONE NO.33231 with e-value of 1.10E-122 and BLAST sequence identity of 82.9
  misc_feature (1)..(290): useful for making plants with altered flowering time as described in USSN 12/281,616
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGFGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 8236 - protein, 283 aa, Oryza sativa subsp. japonica
  misc_feature (1)..(283): Public GI ID NO.34901254
  misc_feature (28)..(265): Pfam Name: MIP Pfam Description: Major intrinsic protein
  misc_feature (1)..(283): Functional Homolog of  Ceres CLONE NO.33231 and BLAST sequence identity of 81.4
  misc_feature (1)..(283): useful for making plants with altered flowering time as described in USSN 12/281,616
MGKEADVEAGGVRDYEDPPPAPLVDIDELGRWSLYRAVIAEFVATLLFLYVTVATVIGYKHQTDASASGDDAACGGVGVLGIAWAFGGMIFILVYCTAGISGGHINPAVTFGLFLARKVSLVRAILYIVAQCLGAVCGVALVKGFQSSFYDRYGGGANELAAGYSKGTGLAAEIIGTFVLVYTVFSATDPKRNARDSHVPVLAPLPIGFAVFMVHLATIPVTGTGINPARSLGAAVVYNNSKAWSDQWIFWVGPFIGAAIAALYHQIVLRASARGYGSFRSNA

SEQ ID NO: 8237 - protein, 288 aa, Oryza sativa
  misc_feature (1)..(288): Public GI ID NO.50910761
  misc_feature (33)..(270): Pfam Name: MIP Pfam Description: Major intrinsic protein
  misc_feature (1)..(288): Functional Homolog of  Ceres CLONE NO.33231 and BLAST sequence identity of 81.6
  misc_feature (1)..(288): useful for making plants with altered flowering time as described in USSN 12/281,616
MAKDIEASAPEGGEFSAKDYTDPPPAPLIDVEELTKWSLYRAVIAEFIATLLFLYITVATVIGYKHQSDATVNTTDAACSGVGILGIAWAFGGMIFILVYCTAGISGGHINPAVTFGLFLARKVSLIRAVLYIIAQCLGAICGVGLVKGFQSSYYARYGGGANELSDGYSKGTGLGAEIIGTFVLVYTVFSATDPKRNARDSHIPVLAPLPIGFAVFMVHLATIPITGTGINPARSLGTAVIYNKDKAWDDQWIFWVGPLIGAAIAAAYHQYVLRASAAKLGSYRSNA

SEQ ID NO: 8238 - protein, 290 aa, Oryza sativa
  misc_feature (1)..(290): Public GI ID NO.50926544
  misc_feature (34)..(271): Pfam Name: MIP Pfam Description: Major intrinsic protein
  misc_feature (1)..(290): Functional Homolog of  Ceres CLONE NO.33231 and BLAST sequence identity of 80.6
  misc_feature (1)..(290): useful for making plants with altered flowering time as described in USSN 12/281,616
MAKDIEAAAAAEGGEYMAKDYSDPPPAPLIDAEELTKWSLYRAVIAEFVATLLFLYITVATVIGYKHQSDPGANAADAACSGVGILGIAWAFGGMIFILVYCTAGVSGGHINPAVTFGLFLARKVSLVRAVLYIVAQSLGAICGVGLVKGFQSAFYVRYGGGANELSDGYSKGTGLAAEIIGTFVLVYTVFSATDPKRNARDSHVPVLAPLPIGFAVFMVHLATIPITGTGINPARSLGAAVIYNQHKAWHDHWIFWVGPLIGAAIAAAYHQYVLRASAAKLGSSSSFRG

SEQ ID NO: 8239 - protein, 284 aa, Vitis vinifera
  misc_feature (1)..(284): Public GI ID NO.55982653
  misc_feature (31)..(263): Pfam Name: MIP Pfam Description: Major intrinsic protein
  misc_feature (1)..(284): Functional Homolog of  Ceres CLONE NO.33231 with e-value of 7.39E-126 and BLAST sequence identity of 83.9
  misc_feature (1)..(284): useful for making plants with altered flowering time as described in USSN 12/281,616
MTKDVEVAEHGSFSAKDYHDPPPAPLFDSVELTKWSFYRALIAEFIATLLFLYITVLTVIGYKSQTAGGDPCGGVGILGIAWSFGGMIFILVYCTAGISGGHINPAVTFGLFLARKVSLIRAILYMVAQCLGAICGVGLVKAFQSAYYDRYGGGANELSTGYSKGTGLGAEIIGTFVLVYTVFSATDPKRSARDSHVPVLAPLPIGFAVFMVHLATIPITGTGINPARSLGAAVIYNNEKAWDDQWIFWVGPFIGAAIAAFYHQFILRAGAVKALGSFRSTTHV

SEQ ID NO: 8240 - protein, 284 aa, Aegiceras corniculatum
  misc_feature (1)..(284): Public GI ID NO.56131022
  misc_feature (30)..(265): Pfam Name: MIP Pfam Description: Major intrinsic protein
  misc_feature (1)..(284): Functional Homolog of  Ceres CLONE NO.33231 with e-value of 7.60E-124 and BLAST sequence identity of 82.2
  misc_feature (1)..(284): useful for making plants with altered flowering time as described in USSN 12/281,616
MAKDIEVGPGANAPKDYQDPPPAPLIDAEELTKWSLYRAVIAEFIATLLFLYITVLTVIGYSSQTDPDKNPDDCGGVGILGIAWAFGGMIFVLVYCTAGISGGHINPAVTLGLFLAQKVSLVRAMLYMMAQCLGAICGCGLVKAFQKSYYTKYGGGANYLHDGYNKGTGLGAEIIGTFVLVYTVFSATDPKRSARDSHVPVLAPLPIGFAVFMVHLATIPITGTGINPARSLGAAVIYGKKKTWDDQWIFWGGPFIGAPIAAFYHQFILRAGAIKALGSYRSNA

SEQ ID NO: 8241 - protein, 285 aa, Populus tremula x Populus tremuloides
  misc_feature (1)..(285): Public GI ID NO.57336896
  misc_feature (31)..(264): Pfam Name: MIP Pfam Description: Major intrinsic protein
  misc_feature (1)..(285): Functional Homolog of  Ceres CLONE NO.33231 with e-value of 2.60E-121 and BLAST sequence identity of 80.3
  misc_feature (1)..(285): useful for making plants with altered flowering time as described in USSN 12/281,616
MAKDMEVAEAGSFSAKDYHDPPPAPLFDAKELTKWSFYRALIAEFIATLLFLYITVLTVIGYKSQIDGSADSCGGVGILGIALAFGGMIFVLVYCTAGISGGHINPAVTFGLFLARKVSLIRAVMYMVAQCLGAICGVGLVKAFQKSYYKKYGGGANTLADGFSIGTGLGAEIIGTFVLVYTVFSATDPKRSARDSHVPVLAPLPIGFAVFMVHLATIPITGTGINPARSLGAAVIYNQDKAWDHHWIFWVGPFAGAAIAAFYHQFILRAGAVKALGSFRSAQRF

SEQ ID NO: 8242 - protein, 285 aa, Populus tremula x Populus tremuloides
  misc_feature (1)..(285): Public GI ID NO.57336898
  misc_feature (29)..(264): Pfam Name: MIP Pfam Description: Major intrinsic protein
  misc_feature (1)..(285): Functional Homolog of  Ceres CLONE NO.33231 with e-value of 8.40E-125 and BLAST sequence identity of 82.5
  misc_feature (1)..(285): useful for making plants with altered flowering time as described in USSN 12/281,616
MGKDIEVGGEFIAKDYHDPPPAPLIDAEELTQWSLYRAVIAEFIATLLFLYITVLTVIGYKSQTDTAKNGDVCGGVGVLGIAWAFGGMIFVLVYCTAGISGGHINPAVTFGLFLARKVSLVRAILYMVAQCLGAICGCGLVKAFQKSYYTKYGGGANGLASGFSKGTALGAEIIGTFVLVYTVFSATDPKRNARDSHVPVLAPLPIGFAVFMVHLATIPITGTGINPARSFGAAVIYNEDKAWDDHWIFWVGPFIGAAIAALYHQYVLRAAAVKALGSFRSSSNI

SEQ ID NO: 8243 - protein, 283 aa, Astragalus membranaceus
  misc_feature (1)..(283): Public GI ID NO.58700408
  misc_feature (31)..(262): Pfam Name: MIP Pfam Description: Major intrinsic protein
  misc_feature (1)..(283): Functional Homolog of  Ceres CLONE NO.33231 with e-value of 6.60E-125 and BLAST sequence identity of 83.8
  misc_feature (1)..(283): useful for making plants with altered flowering time as described in USSN 12/281,616
MGKDVEVAEHGEFSAKDYTDPPPAPLIDMAELASWSFYRAIIAEFIATLLFLYITVLTVIGYKSQSATDQCGGVGILGIAWAFGGMIFVLVYCTAGISGGHINPAVTFGLFLARKVSLIRAVMYMVAQCLGAICGVGFVKAFQKSYYVKFGGGANELADGYNKGTGLAAEIIGTFVLVYTVFSATDPKRSARDSHVPVLAPLPIGFAVFMVHLATIPITGTGINPARSFGAAVIYNKDKAWDDQWIFWVGPFVGAAIAAFYHQFVLRAAAIKALGSFRSNAHN

SEQ ID NO: 8244 - protein, 287 aa, Mimosa pudica
  misc_feature (1)..(287): Public GI ID NO.60498685
  misc_feature (31)..(268): Pfam Name: MIP Pfam Description: Major intrinsic protein
  misc_feature (1)..(287): Functional Homolog of  Ceres CLONE NO.33231 with e-value of 6.29E-120 and BLAST sequence identity of 80.2
  misc_feature (1)..(287): useful for making plants with altered flowering time as described in USSN 12/281,616
MTKDVEVQEQGDFSAKDYHEPPPAPLIDPEELGKWAFYRAVIAEFVATLLFLYVTILTIIGHNSSTDSKKGPGVTDCDGVGILGIAWAFGGMIFILVYCTAGISGGHINPAVTFGLFLGRKVSLIRAVLYMVAQCAGAICGTGLAKAFQKAYYDRYGGGVNFVQPGYSKGTALGAEIIGTFVLVYTVFSATDPKRNARDSHVPVLAPLPIGFAVFMVHLATIPVTGTGINPARSFGAAVIYNGSKAWDDHWIFWVGPAIGALAAAIYHQYILRAAAIKALGSFRSNN

SEQ ID NO: 8245 - protein, 288 aa, Mimosa pudica
  misc_feature (1)..(288): Public GI ID NO.60498689
  misc_feature (31)..(267): Pfam Name: MIP Pfam Description: Major intrinsic protein
  misc_feature (1)..(288): Functional Homolog of  Ceres CLONE NO.33231 with e-value of 1.10E-124 and BLAST sequence identity of 82.3
  misc_feature (1)..(288): useful for making plants with altered flowering time as described in USSN 12/281,616
MAKDVEVAERGSYSAKDYHDPPPAPLIDAEELGKWSFYRALIAEFIATLLFLYITVLTVIGYKSQTDTTVATGDVCGGVGILGIAWAFGGMIFILVYCTAGISGGHINPAVTFGLFLARKVSLIRAILYIVAQCLGAICGVGLVKAFQKAYYTKYGGGANTLGDGYSVGTGLGAEIIGTFVLVYTVFSATDPKRNARDSHVPVLAPLPIGFAVFMVHLATIPVTGTGINPARSFGAAVIFNQQKAWDKHWIFWVGPFIGAAIAAFYHQFILRAGAAKALGSFRSNPSV

SEQ ID NO: 8246 - protein, 281 aa, Mimosa pudica
  misc_feature (1)..(281): Public GI ID NO.60498691
  misc_feature (28)..(260): Pfam Name: MIP Pfam Description: Major intrinsic protein
  misc_feature (1)..(281): Functional Homolog of  Ceres CLONE NO.33231 with e-value of 2.39E-120 and BLAST sequence identity of 81.5
  misc_feature (1)..(281): useful for making plants with altered flowering time as described in USSN 12/281,616
MTKDLEGPPPPHKDYHDPPPAPLLDAAELGKWSFYRAVIAEFVATLLFLYITVLTVIGYKSQIDGGHDCDGVGVLGIAWAFGGMIFILVYCTAGISGGHINPAVTFGLFLARKVSLIRAIAYIVAQCLGAICGCGLVKAFQKAFYNRYGGGANTLSTGYSSGTGLGAEIIGTFVLVYTVFSATDPKRNARDSHVPVLAPLPIGFAVFMVHLTTIPITGTGINPARSFGAAVMYNNFEAWDDHWIFWVGPFIGAAIAAIYHQYVLRAQAAKALGSFRSSSHL

SEQ ID NO: 8247 - protein, 285 aa, Phaseolus vulgaris
  misc_feature (1)..(285): Public GI ID NO.62945921
  misc_feature (31)..(266): Pfam Name: MIP Pfam Description: Major intrinsic protein
  misc_feature (1)..(285): Functional Homolog of  Ceres CLONE NO.33231 with e-value of 1.30E-126 and BLAST sequence identity of 81.9
  misc_feature (1)..(285): useful for making plants with altered flowering time as described in USSN 12/281,616
MAKDVEVQEQGEYAAKDYQDPPPAPLFDPEELTQWSFYRALIAEFIATLLFLYVTVLTIIGYKRQTDANVGGTECDGVGILGIAWAFGGMIFILVYCTAGISGGHINPAVTFGLFLGRKVSLIRALLYIVAQCAGAICGTGLAKGFQKAYYNRCGGGANSVADGYNKGTALGAEIIGTFALVYTVFSATDPKRNARDSHVPVLAPLPIGFAVFMVHLATIPVTGAGINPARSFGAAVIYNNEKIWDDQWIFWVGPIIGAAVAAFYHQYILRAAAIKALGSFRSNA

SEQ ID NO: 8248 - protein, 286 aa, Hordeum vulgare
  misc_feature (1)..(286): Public GI ID NO.68299599
  misc_feature (32)..(269): Pfam Name: MIP Pfam Description: Major intrinsic protein
  misc_feature (1)..(286): Functional Homolog of  Ceres CLONE NO.33231 with e-value of 4.89E-120 and BLAST sequence identity of 80.1
  misc_feature (1)..(286): useful for making plants with altered flowering time as described in USSN 12/281,616
MAKDIEAAPQGGEFSSKDYSDPPPAPIVDFEELTKWSLYRAVIAEFVATLLFLYITVATVIGYKHQSDPTVNTTDAACSGVGILGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGTFVLVYTVFSATDPKRNARDSHIPVLAPLPIGFAVFMVHLATIPITGTGINPARSLGAAVIYNTDKAWDDQWIFWVGPLIGAAIAAAYHQYVLRASAAKLGSYRSN

SEQ ID NO: 8249 - protein, 287 aa, Arabidopsis thaliana
  misc_feature (1)..(287): Public GI ID NO.79314872
  misc_feature (31)..(266): Pfam Name: MIP Pfam Description: Major intrinsic protein
  misc_feature (31)..(266): Pfam Name: MIP Pfam Description: Major intrinsic protein
  misc_feature (1)..(287): Functional Homolog of  Ceres CLONE NO.33231 and BLAST sequence identity of 82.7
  misc_feature (1)..(287): useful for making plants with altered flowering time as described in USSN 12/281,616
MAKDVEAVPGEGFQTRDYQDPPPAPFIDGAELKKWSFYRAVIAEFVATLLFLYITVLTVIGYKIQSDTDAGGVDCGGVGILGIAWAFGGMIFILVYCTAGISGGHINPAVTFGLFLARKVSLPRALLYIIAQCLGAICGVGFVKAFQSSYYTRYGGGANSLADGYSTGTGLAAEIIGTFVLVYTVFSATDPKRSARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 8250 - protein, 281 aa, Prunus mume
  misc_feature (1)..(281): Public GI ID NO.82568687
  misc_feature (31)..(262): Pfam Name: MIP Pfam Description: Major intrinsic protein
  misc_feature (1)..(281): Functional Homolog of  Ceres CLONE NO.33231 with e-value of 6.79E-123 and BLAST sequence identity of 83.8
  misc_feature (1)..(281): useful for making plants with altered flowering time as described in USSN 12/281,616
MAKDVEGAEHGEFAAKDYHDPPPTPFFDAEELTKWSFYRALIAEFVATLLFLYITVLTVIGYKSQSSGDQCGGVGILGIAWAFGGMIFVLVYCTAGISGGHINPAVTFGLFLARKVSLPRAVLYIIAQSLGAICGVGLVKAFQKTYYEEYGGGANELAAGYNKGTGLGAEIIGTFVLVYTVFSATDPKRNARDSHVPVLAPLPIGFAVFIVHLATIPITGTGINPARSFGAAVIYNKDKAWDDQWIFWLGPFIGAAIAALYHQYILRAGAIKALGSFRSNA

SEQ ID NO: 8251 - DNA, 1202 bp, Zea mays; identical to SEQ ID NO: 8208
  misc_feature (1)..(1202): Ceres CLONE ID no.1411718
  misc_feature (1)..(1202): useful for making plants with altered flowering time as described in USSN 12/281,616

SEQ ID NO: 8252 - protein, 285 aa, Zea mays; identical to SEQ ID NO: 8209
  misc_feature (1)..(285): Ceres CLONE ID NO.1411718
  misc_feature (29)..(264): Pfam Name: MIP Pfam Description: Major intrinsic protein
  misc_feature (1)..(285): Functional Homolog of  Ceres CLONE NO.33231 with e-value of 4.50E-126 and BLAST sequence identity of 84.6
  misc_feature (1)..(285): useful for making plants with altered flowering time as described in USSN 12/281,616

SEQ ID NO: 8253 - DNA, 1102 bp, Glycine max
  misc_feature (1)..(1102): Ceres CLONE ID no.1508487
  misc_feature (1)..(1102): useful for making plants with altered flowering time as described in USSN 12/281,616
aaaaactcatcaatctcttcctctatatctctctcatcctcatcatctttggtcatggcaaaggacttggaggtgcaagatggcggagcaacggcggcgagagattatgttgatcctcctcccgctccattgttggacatggaggagtttgggaagtggtcgctctacagagcggtcatagctgagtttgtggcgacacttctcttcctttacgtctcagtcctcaccgtaatcgggtacaaagctcagaccgactcaaacgccggaggagttgactgcggcggcgttggaatattggggattgcatgggctttcggtggaatgatttttgttctcgtttactgtaccgccggtgtctccggtggtcatataaatccggctgtgacgttcggattgttcttagctagaaaagtgtcattggtgcggacagtgttatacattgtggctcagtgccttggtgctatctgcggttgcggtctggtcaaagcattccaaagttcttactacaccagatatggaggtggagccaacgagctagctgacggctacaacaaaggaaccggactaggtgcggagatcatcggcacatttgtcctagtctacaccgttttctcggccacagatcctaagcgaagtgcacgtgactctcacattccagttttggcgccacttcccattggctttgctgtcttcatggttcacctagccaccattcccatcaccggtaccggaatcaacccggcccgaagcttcggtgccgcagttatctacaaccaagaaaaggcctgggacgaccaatggattttctgggtgggaccaatgatcggagcagcagctgctgcattataccatcagtttgttctaagagcggctgggatcaaaagtcttggctcctttaggagctctgcgtaattttaattgtttaaaattaagccacaagttcatctttaataaaatgatgattactacaaattccactacctagaggaagttacgtttatctttttatttatgtactctgtttcttaatttcatggaattttcccttcggttgtaaatgttgtttaatttatgttgctttaagataaaaaaaaaaaaaaaa

SEQ ID NO: 8254 - protein, 285 aa, Glycine max
  misc_feature (1)..(285): Ceres CLONE ID NO.1508487
  misc_feature (31)..(266): Pfam Name: MIP Pfam Description: Major intrinsic protein
  misc_feature (1)..(285): Functional Homolog of  Ceres CLONE NO.33231 with e-value of 7.79E-138 and BLAST sequence identity of 90.8
  misc_feature (1)..(285): useful for making plants with altered flowering time as described in USSN 12/281,616
MAKDLEVQDGGATAARDYVDPPPAPLLDMEEFGKWSLYRAVIAEFVATLLFLYVSVLTVIGYKAQTDSNAGGVDCGGVGILGIAWAFGGMIFVLVYCTAGVSGGHINPAVTFGLFLARKVSLVRTVLYIVAQCLGAICGCGLVKAFQSSYYTRYGGGANELADGYNKGTGLGAEIIGTFVLVYTVFSATDPKRSARDSHIPVLAPLPIGFAVFMVHLATIPITGTGINPARSFGAAVIYNQEKAWDDQWIFWVGPMIGAAAAALYHQFVLRAAGIKSLGSFRSSA

SEQ ID NO: 8255 - protein, 290 aa, Oryza sativa subsp. japonica
  misc_feature (1)..(290): Public GI ID NO.34901270
  misc_feature (34)..(271): Pfam Name: MIP Pfam Description: Major intrinsic protein
  misc_feature (1)..(290): Functional Homolog of  Ceres CLONE NO.33231 of BLAST sequence identity of 83.0
  misc_feature (1)..(290): useful for making plants with altered flowering time as described in USSN 12/281,616
MGKDEVMESGGAAGEFAAKDYTDPPPAPLIDAAELGSWSLYRAVIAEFIATLLFLYITVATVIGYKHQTDASASGADAACGGVGVLGIAWAFGGMIFILVYCTAGISGGHINPAVTFGLFLARKVSLVRAILYIVAQCLGAICGVGLVKAFQSAYFNRYGGGANTLAAGYSKGTGLAAEIIGTFVLVYTVFSATDPKRNARDSHVPVLAPLPIGFAVFMVHLATIPITGTGINPARSIGAAVIFNNEKAWHNHWIFWVGPFVGAAIAAFYHQYILRAGAIKALGSFRSNA

SEQ ID NO: 8256 - protein, 290 aa, Hordeum vulgare
  misc_feature (1)..(290): Public GI ID NO.68533200
  misc_feature (32)..(270): Pfam Name: MIP Pfam Description: Major intrinsic protein
  misc_feature (1)..(290): Functional Homolog of  Ceres CLONE NO.33231 with e-value of 7.00E-121 and BLAST sequence identity of 81.0
  misc_feature (1)..(290): useful for making plants with altered flowering time as described in USSN 12/281,616
MAKDIEAAPPGGEYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRAVLYIIAQCLGAICGVGLVKGFQSAFYVRYGGGANELSAGYSKGTGLAAEIIGTFVLVYTVFSATDPKRSARDSHVPVLAPLPIGFAVFMVHLATIPITGTGINPARSFGAAVIYNNEKAWDDHWMFWVGPFIGAAIAALYHQYVLRASATKFGSSASFGSR

SEQ ID NO: 8257 - DNA, 1527 bp, Arabidopsis thaliana
  misc_feature (1)..(1527): Ceres CLONE ID no.33877
  misc_feature (1)..(1527): useful for making plants with altered flowering time as described in USSN 12/281,616
aggtcgcaacaccgcaatagatcttttccccaagtttcagacaaacataaagcagcagagaaaattttcaagtttcaaagagcttttccatcaccaagcaaatttggatatttgtcagcaaaatctgcagctaaattgggacttgtcttgttagttcaaagattgaaacttttttggttaattgtttggcggaagaagatttacaatgggagaggagcatccgagaaagcggtctagacaacattttgaagcggaggcgagaaacgtatcgttgtttgaatcccctcaatgcgaaacctccaagtggtatttcagcagggaagagattgagcgtttctctccatccagaaaagatgggattgatcttgtgaaggagtcgtttttacggtcttcgtattgcaccttcctgcaaagacttggcatgaagcttcatgtgtcccaggttacaatatcatgtgcaatggtgatgtgccacaggttttacatgcgccaatctcatgcaaaaaatgactggcagacaatagcgacttccagtctgttcctcgcttgcaaagctgaagatgagccatgtcaactgtccagtgtcgttgtagcgtcttatgaaataatttatgagtgggatccttctgcctcaattagaatccatcaaactgagtgttatcatgaatttaaagaaattattttgtccggggaaagtcttctgctgagcacaagtgctttccatttagacattgaacttccctacaaacctctggctgcggctttgaatagactgaacgcttggcctgaccttgcaacagctgcatggaattttgtgcatgactggattcgaaccacactatgcttgcagtacaaaccccatgttattgcaacagccactgtgcacctagctgctacgtttcagaatgcgaaagtaggcagcaggagagattggtggttggagtttggagttacaactaagctattaaaagaggtaatccaggagatgtgcacactgatagaagtggacagaaggaggaatatgccacctccacctccacctccaagaagagagttaagttgggcaatacctgcagccgtaaagccggtccatatggctagagcttatccgtttcacggctaccctttgcagtcctatagacaggctggcatctggtgagccattgttgagcagcatgaagatgtaatctctcttagagtcttgagttggtttatcaataaaagatttccgtagagactcatgagagaggcagtgtagcattatatagagatccgagtgaggtgcttctgtctaagttaagcgtctcatgtatgaccaaagtggattctctcgagattcttggtctctgttctcgatagagagagattatgtatagaagtgtcccattcacatgttataatactagctgactttatatcgtttgtatatctggaatctatgtttttggtttctttaaaaagtttaaagttgttttgattttgactaattctctcattgttaagtaatttggtttttgatgaagtgcc

SEQ ID NO: 8258 - protein, 317 aa, Arabidopsis thaliana
  misc_feature (1)..(317): Ceres CLONE ID NO.33877
  misc_feature (31)..(175): Pfam Name: Cyclin_N Pfam Description: Cyclin, N-terminal domain
  misc_feature (1)..(317): useful for making plants with altered flowering time as described in USSN 12/281,616
MGEEHPRKRSRQHFEAEARNVSLFESPQCETSKWYFSREEIERFSPSRKDGIDLVKESFLRSSYCTFLQRLGMKLHVSQVTISCAMVMCHRFYMRQSHAKNDWQTIATSSLFLACKAEDEPCQLSSVVVASYEIIYEWDPSASIRIHQTECYHEFKEIILSGESLLLSTSAFHLDIELPYKPLAAALNRLNAWPDLATAAWNFVHDWIRTTLCLQYKPHVIATATVHLAATFQNAKVGSRRDWWLEFGVTTKLLKEVIQEMCTLIEVDRRRNMPPPPPPPRRELSWAIPAAVKPVHMARAYPFHGYPLQSYRQAGIW

SEQ ID NO: 8259 - DNA, 2044 bp, Zea mays
  misc_feature (1)..(2044): Ceres CLONE ID no.354421
  misc_feature (1)..(2044): useful for making plants with altered flowering time as described in USSN 12/281,616
aaacagtaccgtgcctggcgattccgcgtccacgcacctctcagttagggtttcggactcgaggccaagttcatctccggacgagcataccgtgagccccaacgctccaggtggtccgcttcacttccgagcgcccctctcccgacagccgtctcctcctcaccgctgcttcatcacctagccgtcgccacccatcgcctacagcgacagccgtctgccgtcacagcggagcgcccctcagatccaagggacgctgcacgagcgcaagagcaggttgttgagaaggggaatataatcatggatatcatgcagactagtgactcttcacatcatggaattgtagaaaatagcccctacagaattccatatgacagacatgcagaaggtggtcaacttggtgcttcatggtattttagtagaaaagaaatagaggagaattccctttccaggagagatggcattgatctgaagaaagagtcttatcttcgcaagtcatattgcacatttctgcaggatttggggatgagacttaaagtacctcaagtgacaattgctactgctatagtgttctgtcatcggttctttcttcgtcaatcgcatgccaaaaatgacagacggacaattgcaacagtatgcatgttcttggcgggaaaagttgaagaaacacccagacctctgaaggatgtcatacttctttcatatgagatcatccacaaaaaggatcctgctgcagttcaacgaataaaacagaaggaagtatatgaacaacaaaaggaacttattttactcggggaacgtgttgtgcttgtgacacttggttttgatttgaatgtgaaccatccttacaagcccttggttgaagcaataaaaatattcaaggttgctcaaaatgcacttgctcaagttgcctggaattttgtcaatgatgggctccgcacttcactttgcctgcaatttaaaccgcaccatattgcggctggtgcaatcttcctcgctgcgaagtttctcaaagtcaagcttccatcagatggcgagaagktctggtggcaagagtttgatgtaactccgtggcagctggaagaggttagcaaccagatgttggaactgtatgagcaaaaccgtgttcaaccaccaccatcacaaggcaatgatactgaaggcagttctgcaagtgttgcgaatcaacgtgttcctggtaaagttccaggagtagctgatgaacctcctgcccatgaccataaccaagcacccagaccatcgagccagcagaacatgctagaccaccgtggctatgaccaccctcacccagataagcaaaactataggatacctccaaatgatgcaagggatggcactgctaatagcaacgaaggtcccaatgtgtcgtcttcaatgatggatgcgatgaagaaggtaaacaaggataaggtgaaagcggcactggagaagcgtaggaaatcgaaaggtgatttttcaagaaaggtcgatgtgatggatgacgatgacctcattgagagggagctagaacatggcgtggagttggctgccgaggatgagaaggtcaagcaggagagaaagcagagctggcctcatcttgcacaccaccagagcaccaaccgtgagaataccgaagagggtgagctgtccatggacagtcaagaataccgttctccggagcatgacaatcggaagagaaaggatgtgcgtgagtaccggaactacgatcgtgacgaaagggaccttaaaaggctaagatcatgagagttgcacttttgtcggagtctcatgttgttcgtgccataacatgatgtggaacctctatctttctgtcacaggtgtacttgatgcttatttggtatgctgggggatttgaactgttacatatataagtttataagatggtttccccacggtcatgtatgtgtttagccatgttggcaattgagatggcgctgtgccttgagtattccacaggtttatgctggaaacaacatttaaggaagctgcgtcctacgggtatctgaaatgtatgtattttgattcc

SEQ ID NO: 8260 - protein, 487 aa, Zea mays
  misc_feature (1)..(487): Ceres CLONE ID NO.354421
  misc_feature (34)..(178): Pfam Name: Cyclin_N Pfam Description: Cyclin, N-terminal domain
  misc_feature (1)..(487): Functional Homolog of  Ceres CLONE NO.33877 with e-value of 2.90E-60 and BLAST sequence identity of 54.3
  misc_feature (248)..(248): Xaa is any aa, unknown, or other
  misc_feature (1)..(487): useful for making plants with altered flowering time as described in USSN 12/281,616
MDIMQTSDSSHHGIVENSPYRIPYDRHAEGGQLGASWYFSRKEIEENSLSRRDGIDLKKESYLRKSYCTFLQDLGMRLKVPQVTIATAIVFCHRFFLRQSHAKNDRRTIATVCMFLAGKVEETPRPLKDVILLSYEIIHKKDPAAVQRIKQKEVYEQQKELILLGERVVLVTLGFDLNVNHPYKPLVEAIKIFKVAQNALAQVAWNFVNDGLRTSLCLQFKPHHIAAGAIFLAAKFLKVKLPSDGEKXWWQEFDVTPWQLEEVSNQMLELYEQNRVQPPPSQGNDTEGSSASVANQRVPGKVPGVADEPPAHDHNQAPRPSSQQNMLDHRGYDHPHPDKQNYRIPPNDARDGTANSNEGPNVSSSMMDAMKKVNKDKVKAALEKRRKSKGDFSRKVDVMDDDDLIERELEHGVELAAEDEKVKQERKQSWPHLAHHQSTNRENTEEGELSMDSQEYRSPEHDNRKRKDVREYRNYDRDERDLKRLRS

SEQ ID NO: 8261 - DNA, 1281 bp, Populus balsamifera subsp. trichocarpa
  misc_feature (1)..(1281): Ceres ANNOT ID no.1442675
  misc_feature (1)..(1281): useful for making plants with altered flowering time as described in USSN 12/281,616
atggctaggattgcaactagcatgcacttgccgaaggagcctcagtatcatacacgcaagtggtacttcagtagacaagaaattgaagatttttccccttctagaagggatggtattgacgttgagaaggagtctcaattacggaaattgtactgttcatttattaaagagctcggcgtgaagcttaaagtgccccaggtgacaatagcatgtgcattgatattgtgccaccggttttacatgcgtcaatctcatgcaaagaatgattggaagacaatggcatctgcaagcatgtttcttgcttgcaaactggaggaaactccgcgcttgctgagggatgttgttgttgtggcttatgagctgatgcacaaaagggatccttctgcctcacatagaatcaggcagataggattttgcagtagtcagaaggaattgcttgtaactggagagaggcttttattggcaacaattggttttgatcttgatgtccaacttccttacaagccacttgtaaatgctttgaagaaattgaacatatacccagatcttgcaaaagtagcttggaattttgtgaatgattggctttgcacaactttatgcttgcagtacaagccccattacattgcagctggttccatgtatctcgctgccaaatttcaaaaggtgaaacttcctacagagaagggaaatgtctggtggctggagtttgacatttcacctaaacaattagaagaggtcatccaacagatggccaggttgttagagcaagatccaaaaaggactcttccggcaacgcatgggagggttccacaatctaaagcttctgccaagaagatggttaccagtagtgcgcaatcagctgttacaagtgtatcaatgtctaattcacttgctagcgatggggctgtgatggaagcttcatcctcatctgacagaaacaccagcctgaatgaagttttaccatgtcaaacaattgatagtggtgcaagcagtgttgttgaggatggtgatggtaagaatcagccaagaacaggggactatgagttgagctccagcagcaatattgccccatcttataattcccatcataacattgatgtccaccagattagagagacattaaagagacggagatgccagatagctgcaaaaagtagagcttcattgtccaatgaaaccatggatgctgagttagatacggaaacctggatagaaagggagctagaagaagggatagagttgcaaactgctccttcagagaagaaacgaaggaaggtgtga

SEQ ID NO: 8262 - protein, 426 aa, Populus balsamifera subsp. trichocarpa
  misc_feature (1)..(426): Ceres ANNOT ID NO.1442675
  misc_feature (18)..(162): Pfam Name: Cyclin_N Pfam Description: Cyclin, N-terminal domain
  misc_feature (1)..(426): Functional Homolog of  Ceres CLONE NO.33877 with e-value of 2.20E-78 and BLAST sequence identity of 57.5
  misc_feature (1)..(426): useful for making plants with altered flowering time as described in USSN 12/281,616
MARIATSMHLPKEPQYHTRKWYFSRQEIEDFSPSRRDGIDVEKESQLRKLYCSFIKELGVKLKVPQVTIACALILCHRFYMRQSHAKNDWKTMASASMFLACKLEETPRLLRDVVVVAYELMHKRDPSASHRIRQIGFCSSQKELLVTGERLLLATIGFDLDVQLPYKPLVNALKKLNIYPDLAKVAWNFVNDWLCTTLCLQYKPHYIAAGSMYLAAKFQKVKLPTEKGNVWWLEFDISPKQLEEVIQQMARLLEQDPKRTLPATHGRVPQSKASAKKMVTSSAQSAVTSVSMSNSLASDGAVMEASSSSDRNTSLNEVLPCQTIDSGASSVVEDGDGKNQPRTGDYELSSSSNIAPSYNSHHNIDVHQIRETLKRRRCQIAAKSRASLSNETMDAELDTETWIERELEEGIELQTAPSEKKRRKV

SEQ ID NO: 8263 - DNA, 1738 bp, Zea mays
  misc_feature (1)..(1738): Ceres CLONE ID no.354406
  misc_feature (1)..(1738): useful for making plants with altered flowering time as described in USSN 12/281,616
atgctcgggtccgatggttcccgtctccgacaccgcactgctcacaacttcgacaccacttccgactccgtcgccaggtccgccgccggcgagagcgccgcagtcgctagctccgtatgcagagtatacagctgcagcggcgggtgctcctgccggtaccgagtgagtgtgagacggcggaagctccacgtccagcggcgtgcccctccgtcttccgtcactccagatccgaggcagttcactgctgggacgcagtcagagctgttcggtggagctgacaggtttttgagaagaggaatataatcatggttatcatgcagagcagtgactcttcacataatggttcacataatggaattgtagaaaatagtccgtacagaattccatatgacagacatgcagaaggtgatcaacttggtgcttcatggtattttagtagaaaagaaatagaggagaattccgtatcgaggagggacggcattgatctgaagaaagagtcttatcttcgcaagtcatattgcacatttctgcaggatttggggatgaggcttaaagtgcctcaagtgacaattgctactgctatagtgttctgtcatcggttttttcttcgtcaatctcatgcgaaaaatgacagacggacaattgcaacagtatgtatgttcttggcgggaaaagttgaagaaacacccagacctctgaaggatgtcatacttctttcatacgagatcatccacaaaaaggatcctgctgcagttcaacgaataaaacataaggaagtatatgaacaacagaaggaacttattttacttggggaacgtgttgttcttgtaacacttggttttgattttaatgtgaaccatccttacaagcccttggttgaagcaataaaaaaatttgaggttgctcaaaatgcacttgcgcaagttgcctggaattttgtcaatgatgggctccgcacttcactttgcctgcaatttaaaccgcaccatattgcggctggcgcaatcttcctggctgcgaagtttcttaaagtcaagcttccatcagatggcgagaaggtctggtggcaagagtttgatgtaactccgcggcagttggaagaggttagcaaccagatgttggaactctatgagcagaaccgtgttcaaccaccaccatcacaaggtaatgatactgaaggcagttctgtaactgctgtgaatcaacgtgctctgggtaaagttccaggagtagttgatgaacctcctgcccatgaacataaccaagcaaccaggcaatcgagccagcagaacatgtcaggccaccatggctatgatcaccctcatccggagaagcgaaactatagggtacccccaaatgaagcaagggatgacagtgctaacagcagcgagggtcccaacgtgtcagcctcgatgatggatgcaatgaaaaagataaacaaggataaggtgaaagcggccctggagaagcggagatcaaaaggtgacctttcgatatgctctcaaataggatgttctgctcccctcttgtatttgtatgcaggaaagggtttgtagggagtttaccccccccccccccccccccgcctttcttttgggcaraaaracatattctggaagcctttcartakttcatttatcavcaacaattgcatctttcttccattgctgkgcaccttgtatcacctatcaaaatgtggtcatatggggattgtacggcavcactgctgkgtgtgttg

SEQ ID NO: 8264 - protein, 416 aa, Zea mays
  misc_feature (1)..(416): Ceres CLONE ID NO.354406
  misc_feature (38)..(182): Pfam Name: Cyclin_N Pfam Description: Cyclin, N-terminal domain
  misc_feature (1)..(416): Functional Homolog of  Ceres CLONE NO.33877 with e-value of 1.49E-61 and BLAST sequence identity of 54.3
  misc_feature (1)..(416): useful for making plants with altered flowering time as described in USSN 12/281,616
MVIMQSSDSSHNGSHNGIVENSPYRIPYDRHAEGDQLGASWYFSRKEIEENSVSRRDGIDLKKESYLRKSYCTFLQDLGMRLKVPQVTIATAIVFCHRFFLRQSHAKNDRRTIATVCMFLAGKVEETPRPLKDVILLSYEIIHKKDPAAVQRIKHKEVYEQQKELILLGERVVLVTLGFDFNVNHPYKPLVEAIKKFEVAQNALAQVAWNFVNDGLRTSLCLQFKPHHIAAGAIFLAAKFLKVKLPSDGEKVWWQEFDVTPRQLEEVSNQMLELYEQNRVQPPPSQGNDTEGSSVTAVNQRALGKVPGVVDEPPAHEHNQATRQSSQQNMSGHHGYDHPHPEKRNYRVPPNEARDDSANSSEGPNVSASMMDAMKKINKDKVKAALEKRRSKGDLSICSQIGCSAPLLYLYAGKGL

SEQ ID NO: 8265 - protein, 543 aa, Oryza sativa subsp. japonica
  misc_feature (1)..(543): Public GI ID NO.77555729
  misc_feature (33)..(177): Pfam Name: Cyclin_N Pfam Description: Cyclin, N-terminal domain
  misc_feature (1)..(543): Functional Homolog of  Ceres CLONE NO.33877 sequence identity of 55.7
  misc_feature (1)..(543): useful for making plants with altered flowering time as described in USSN 12/281,616
MAMMPSDSSHHGIVENSPYRTTQGRNEETGELGASWYFSRKEIEENSPSRRDGIDLKKESYLRKSYCTFLQDLGMRLKVPQVTIATAIVFCHRFYLRQSHAKNDRRTIATVCMFLAGKVEETPRPLKDVILVSYEIIHKKDPAAGQRIKQKEVYDQQKELILLAERVVLATLGFDLNVHHPYKPLVEAIRKFKVAQNALAQVAWNFVNDGLRTSLCLQFKPHHIAAGAIFLAAKFLKVKLPSDGEKVWWQEFDVTPRQLEEVSNQMLELYEQNCAAQAQPSHGNEAEGSSASVPNQRVSVKSEETPLPHQSKQSSSQHSTGAPSHHGVEHSNLEKQTVDQKMLQNDNGDHGSNKTRSNQSGSRVDFGANDGLHHDKQSMTENKNLPSHGNSSEIRDVNRNGNDGTNVTSLMVNKIDKDKVKAQMEKQRKLKGDVARKVEVIDDDDDLERQLEHDIELAVEDNKIKQERKQSSPHVMHRGDHRNADQVTGNGHLGKQNTPETAQDAPMDDIKEQRNSHGSKHHDSHDTAHERGERDYKRPRPEG

SEQ ID NO: 8266 - DNA, 690 bp, Arabidopsis thaliana
  misc_feature (1)..(690): Ceres CLONE ID no.101876
  misc_feature (1)..(690): Ceres LOCUS ID At3g03170
  misc_feature (1)..(690): useful for making plants with altered flowering time as described in USSN 12/281,616
aaaaataattatagtcgtataaatgccactgttctctcaactcttaatcaattagaagccgcttagaagaaaaaatgcactatcaagaacagatggagtctcttatgttgggtgaagaacgcagacgcggaaactacaccagagacgtagacgcggactcagatgaaggtgttaactctccctcttcttttccaaactcccctgatgattcggaccgtcgcagttcttcttcttcttcaaggagaggattgtcgaaacattacaaaggtaaatcacaatcgttcacaacgttggcagaagcgctaactgtggaagatctcgcgaasctgagaatccattcaacgcaaagctgaagcagcgacgagagagccctcactgtcgtagattatcaggatgcggcggcgcatcggagcgaaatttaagtgtccacgacgtttttctcgctgggaacgatagaccgccgcgactttccggtaacagaccgcctccgagagcccagacgctctcsgcggctcatatttcggctttgctcactcgaacctaaaccggaagagaaccgggtttcgtttgggacgatgtttttcaaatcttttgttttctaatcttgtacaagttgttgttactttaaagtgttttgactcttttgataattttgtaagtttcagtttaatttagagagcacttaacagt

SEQ ID NO: 8267 - protein, 156 aa, Arabidopsis thaliana
  misc_feature (1)..(156): Ceres CLONE ID NO.101876
  misc_feature (1)..(156): Ceres LOCUS ID At3g03170
  misc_feature (1)..(156): useful for making plants with altered flowering time as described in USSN 12/281,616
MHYQEQMESLMLGEERRRGNYTRDVDADSDEGVNSPSSFPNSPDDSDRRSSSSSSRRGLSKHYKGKSQSFTTLAEALTVEDLAKPENPFNAKLKQRRESPHCRRLSGCGGASERNLSVHDVFLAGNDRPPRLSGNRPPPRAQTLSAAHISALLTRT

SEQ ID NO: 8268 - DNA, 780 bp, Triticum aestivum
  misc_feature (1)..(780): Ceres CLONE ID no.848588
  misc_feature (1)..(780): useful for making plants with altered flowering time as described in USSN 12/281,616
tccaagctatcatcctgctagcacccgtgaactccagccattcacgctgcgtcgatcgtttggtttcgtgcgtgcgttgtttgtgatcgtgtgatctgttcgggagatggaggcttacatgctgttcccgcggagcaatggaaagagctgcgaggaggagcaggaggaggacatcggctgcccgtccgagtccgaggtgtcggcggccggctccatgctgtcgtcggacgaggagctcgacgacgacgccacctccagctccagctcctccggatccaccgacaacttccagatgtcctccctcatggcgcagctcccgctcaagaggggtctgtccaagttcttcgacggcaagtcgcagtcgttcgcgtcgctcgcggcggtgggcggcctggaggacctggccaagccgccgggcaagcggatcaagacgtcgcggagctgcgaggtcgggctgcaggacgcgcaccgccggcggttcgcgcgccacaatgccgcggccttcaagaaggtgtccaaagggcggctgtccgcgctcggcagggcgccgccgctccggccgctgacagcgagcgcggcgaggcccaagggcttgcccgtgcgggctccgctgttcgtttaggagatttcgcccgcagattagtcgtgtcggttgtggcgtgctcaaagagcagttggtgcggttgttacgtggattttgacatggtaactgaccggaaggtggccggctggtcgatggatgtgtaaatacagaaatgagaaacaaaaaaaaaaaaaaaa

SEQ ID NO: 8269 - protein, 171 aa, Triticum aestivum
  misc_feature (1)..(171): Ceres CLONE ID NO.848588
  misc_feature (1)..(171): Functional Homolog of  Ceres CLONE NO.101876 with e-value of 2.30E-7 and BLAST sequence identity of 38.5
  misc_feature (1)..(171): useful for making plants with altered flowering time as described in USSN 12/281,616
MEAYMLFPRSNGKSCEEEQEEDIGCPSESEVSAAGSMLSSDEELDDDATSSSSSSGSTDNFQMSSLMAQLPLKRGLSKFFDGKSQSFASLAAVGGLEDLAKPPGKRIKTSRSCEVGLQDAHRRRFARHNAAAFKKVSKGRLSALGRAPPLRPLTASAARPKGLPVRAPLFV

SEQ ID NO: 8270 - DNA, 720 bp, Brassica napus
  misc_feature (1)..(720): Ceres CLONE ID no.947386
  misc_feature (1)..(720): useful for making plants with altered flowering time as described in USSN 12/281,616
gtatataaaaagggcactgtttccatgctcaactcttgataaattataagcgcctttgaagagaagaaaaaaaaaatgcattatcaagaacagatggagtctcttatgttgggtgaagaacgcagacgcgaaaactgcgttagagacgcagacgcggacgcagatgaaggttttaactctccctcttcttttccaaactctcctgacgaatcagaccgtcgcagttcttcttcttcaaggagaggattgtcaaaacattacagaggcaagtcacagtccttcacgtcgctgtcggaagcgctgacagtagaagatctcgcgaaacccgagaatcctctcaacgcgaaactgaagcagcgacgggagagctctcactgtcgacgattatccggttgcggcggtgcatcgcagcaaaatctagctggccacgacgctttcttcgccggaaacgataggcagccgagactttccggtaacagactgcctccgagagctcagacgctttcggcggctcacatatcggctttgctcactcgaacctgaaccgggaagcttttagtttatttgtttatctaaaccggaatagaaccgggtttcgtttgggatgatgtttactggagcttcagtcttytgaattgtgtgagaatgtataaattataagtatttagactcttatgatcgtttcgaaattttcagtttaatctaaattagctcaagccg

SEQ ID NO: 8271 - protein, 155 aa, Brassica napus
  misc_feature (1)..(155): Ceres CLONE ID NO.947386
  misc_feature (1)..(155): Functional Homolog of  Ceres CLONE NO.101876 with e-value of 6.40E-67 and BLAST sequence identity of 87.0
  misc_feature (1)..(155): useful for making plants with altered flowering time as described in USSN 12/281,616
MHYQEQMESLMLGEERRRENCVRDADADADEGFNSPSSFPNSPDESDRRSSSSSRRGLSKHYRGKSQSFTSLSEALTVEDLAKPENPLNAKLKQRRESSHCRRLSGCGGASQQNLAGHDAFFAGNDRQPRLSGNRLPPRAQTLSAAHISALLTRT

SEQ ID NO: 8272 - DNA, 414 bp, Brassica napus
  misc_feature (1)..(414): Ceres CLONE ID no.961460
  misc_feature (1)..(414): useful for making plants with altered flowering time as described in USSN 12/281,616
aatatatataaaaagggcactgtttctatgctcaagtcttgataaattagaaggaagagaaaaaaaaatgcattatcaagaacagatggagtctcttatgttgggtgaagaacgcagacgcgaaaactgcgttagagacgcagacgcggacacagatgaaggttttaactctccctcttcttttccaaactctcctgacgaatcagaccgtcgcagttcttcttcttcaaggagaggattgtcaaaacattacagaggcaagtcacagtccttcacgtcgttgtcggaagcgctgacagtagaagatctcgcgaaacccgagaatcctctcaacgcaaagctgaagcagcgacgggagagctctcactgtcgacgattatccggttgcggcggtgcatcgcagcaaaatctagc

SEQ ID NO: 8273 - protein, 115 aa, Brassica napus
  misc_feature (1)..(115): Ceres CLONE ID NO.961460
  misc_feature (1)..(115): Functional Homolog of  Ceres CLONE NO.101876 and BLAST sequence identity of 87.8
  misc_feature (1)..(115): useful for making plants with altered flowering time as described in USSN 12/281,616
MHYQEQMESLMLGEERRRENCVRDADADTDEGFNSPSSFPNSPDESDRRSSSSSRRGLSKHYRGKSQSFTSLSEALTVEDLAKPENPLNAKLKQRRESSHCRRLSGCGGASQQNL

SEQ ID NO: 8274 - DNA, 680 bp, Parthenium argentatum
  misc_feature (1)..(680): Ceres CLONE ID no.1609830
  misc_feature (1)..(680): useful for making plants with altered flowering time as described in USSN 12/281,616
atagcatgatggtgatgcatatgcagatgggttcttcttcattagatcaagaaaacaagatcgggttcatgggtcatgatgaagaagaagatgtatattcatcggatgcttcgagtgttgtgtcttcagatgatgaatctgaccatgatgactttgaacaaagtaattcttcatcggataacaatcatgcgttaggaagcatgtctgatctacttcaacaacttccttccaagagagggttatccaaacactttcaagggaaatcacaatcattcacatccttatcaaaagtgacatgtttagaagatcttgcaaagccagaaaacccttacaacaagaaaataaaatcatgcaaaagttacgcagcattatcaagagttcttccacctccaacacgaagcgcatcatcttcaaagctcttcacgaagacgtcgtcttcgagagcttcttgttcttcactaagcaatagcagcaggccaccaactcatccgtcccatagcaatggtgccacaagtggttctggtttctcaaatcaaacacctttgtttgtttgaggtaatcgtgtttgattcgattggtttgttgttggtatgtatggtcttggttctcggcttttaggatggtcgaaagagcgttttgtggaggatgttttcatggatcgtattcgtgtatttgagtta

SEQ ID NO: 8275 - protein, 182 aa, Parthenium argentatum
  misc_feature (1)..(182): Ceres CLONE ID NO.1609830
  misc_feature (1)..(182): Functional Homolog of  Ceres CLONE NO.101876 with e-value of 7.29E-11 and BLAST sequence identity of 45.7
  misc_feature (1)..(182): useful for making plants with altered flowering time as described in USSN 12/281,616
MMVMHMQMGSSSLDQENKIGFMGHDEEEDVYSSDASSVVSSDDESDHDDFEQSNSSSDNNHALGSMSDLLQQLPSKRGLSKHFQGKSQSFTSLSKVTCLEDLAKPENPYNKKIKSCKSYAALSRVLPPPTRSASSSKLFTKTSSSRASCSSLSNSSRPPTHPSHSNGATSGSGFSNQTPLFV

SEQ ID NO: 8276 - DNA, 1048 bp, Arabidopsis thaliana
  misc_feature (1)..(1048): Ceres CLONE ID no.156373
  misc_feature (1)..(1048): Ceres LOCUS ID At3g11200
  misc_feature (1)..(1048): useful for making plants with altered flowering time as described in USSN 12/281,616
tttttaaaaaacttctccttcttgttccgtctgcttctctccatctccttccatatctattgttctctctctcttcatgcccgaacgcatcgggtctcaaaaaccattgatacagacatcgatccttgtcaactagtactgatctataaatcttataaaaatctgtagagatatggccgccgcagccgtttcctctaaccctcgcaccgttgaagagatcttcaaagattattccgctcgtcgtgccgctcttcttcgtgctctcactaaagatgttgatgatttttactctcaatgcgatccggaaaaggagaatttgtgtttgtacggacaccctaatgagtcatgggaagtgaatctaccagcagaggaagtgcctccggagctacctgagcctgctcttggtatcaatttcgctagagatggtatgcagaggaaagattggctttctcttgttgctgttcacagtgattgttggttgctctctgtttctttctactttggagctcgtcttaatcgcaatgagaggaagcggttattcagtctgatcaacgatctcccaactctcttcgatgtagtgactggtaggaaagccatgaaagacaacaagccaagctcggactcaggaagcaaatccagaaatggcactaagagatcaatagacgggcagacaaagagctcaacaccgaaactaatggaagagagctatgaggaggaggaagaagaagacgagcatggagacactctctgtggaagctgtggaggtcattacacaaatgaggagttctggatttgctgtgatgtttgtgaacgttggtaccatggaaaatgcgtcaagataactccggctaaagcagagagcatcaagcagtataaatgcccgccttgctgtgcaaagaaaggaagacagtgatgctgatcaattgatgatgatgatgatgatgatctctcagagagactctggttctcatgttttaatcaatatgttaatcaactttttttcttttcttctctttttttctttaaccttcttaattttaaagctttc

SEQ ID NO: 8277 - protein, 246 aa, Arabidopsis thaliana
  misc_feature (1)..(246): Ceres CLONE ID NO.156373
  misc_feature (1)..(246): Ceres LOCUS ID At3g11200
  misc_feature (1)..(246): useful for making plants with altered flowering time as described in USSN 12/281,616
MAAAAVSSNPRTVEEIFKDYSARRAALLRALTKDVDDFYSQCDPEKENLCLYGHPNESWEVNLPAEEVPPELPEPALGINFARDGMQRKDWLSLVAVHSDCWLLSVSFYFGARLNRNERKRLFSLINDLPTLFDVVTGRKAMKDNKPSSDSGSKSRNGTKRSIDGQTKSSTPKLMEESYEEEEEEDEHGDTLCGSCGGHYTNEEFWICCDVCERWYHGKCVKITPAKAESIKQYKCPPCCAKKGRQ

SEQ ID NO: 8278 - DNA, 714 bp, Populus balsamifera subsp. trichocarpa
  misc_feature (1)..(714): Ceres ANNOT ID no.1511533
  misc_feature (1)..(714): useful for making plants with altered flowering time as described in USSN 12/281,616
atggcttccatactcacaagccctcgcactgtagaagagatcttcaaagattacagcgctcgtcgctctgccctcgttcgtgctctcactatcgaagccgatgaagtttacattcaatgcgatccagaaaaagaaaatctgtgcttgtatggacatccaactgagtcctgggaggtgaccctgccagctgaggaagttcccccggagctccctgagcctgctttgggcattaattttgccagggatgggatgagtcgtaaagattggctctctcttgtggctgtccatagtgactgttggttgctttccatggcattctactttggtgcacgacttaatcgcaacgacaggaagcgattgtttagcatgataaatgatctgcccaccctctttgaaattgtaactgggaggaaaccagcagaagacaaacctagtgcagaaagcggcagcaaatccaggaataacacaaagagatcaatagatggacaggcgagaagtaattccaagttaagttatgtggaggatgaagacgagcatggagacaccatttgtgggagctgtgcagggaactacaatgccgatgagttttggattggttgtgacatctgtgaacgatggtaccatggaaaatgtgtgaagataacaccagcaaaagcagaaagtatcaagcagtacaaatgcccttcttgcagcacaaagaagtccaggcactaa

SEQ ID NO: 8279 - protein, 237 aa, Populus balsamifera subsp. trichocarpa
  misc_feature (1)..(237): Ceres ANNOT ID NO.1511533
  misc_feature (183)..(233): Pfam Name: PHD Pfam Description: PHD-finger
  misc_feature (1)..(237): Functional Homolog of  Ceres CLONE NO.156373 with e-value of 1.59E-102 and BLAST sequence identity of 80.4
  misc_feature (1)..(237): useful for making plants with altered flowering time as described in USSN 12/281,616
MASILTSPRTVEEIFKDYSARRSALVRALTIEADEVYIQCDPEKENLCLYGHPTESWEVTLPAEEVPPELPEPALGINFARDGMSRKDWLSLVAVHSDCWLLSMAFYFGARLNRNDRKRLFSMINDLPTLFEIVTGRKPAEDKPSAESGSKSRNNTKRSIDGQARSNSKLSYVEDEDEHGDTICGSCAGNYNADEFWIGCDICERWYHGKCVKITPAKAESIKQYKCPSCSTKKSRH

SEQ ID NO: 8280 - DNA, 702 bp, Populus balsamifera subsp. trichocarpa
  misc_feature (1)..(702): Ceres ANNOT ID no.1518013
  misc_feature (1)..(702): useful for making plants with altered flowering time as described in USSN 12/281,616
atggcgtcccctcgcactgtagaagagatcttcaaagattacaacgcccgtcgctctgccctcgttcgcgctctcactattgaggctgatgaagtctaccttcaatgcgatccagaaaaagagaatttgtgtctgtatggacatccaaacgagtcctgggaagtgactctgccagcagaggaagttccgccagagctccctgagccggcgttgggcattaattttgccagagatggaatgacgcgtaaagactggctttctcttgttgctgtgcacagtgacagttggttgctttcagtgggattctactttggtgcacgacttaatcgcaacgaaaggaagcgactgtttagcatggtaaatgatctgcccaccctctttgaaattgtgaccgggaggaaaccagtagaagataagcctagtgctgacggtggtagcaaatccaggaataacacaaagagatcaactgatggacaggcaagaagcaattccaagttaagttacgtggaggatgaagatgagcatggggacaccctttgcgggagctgtggagggaactacaatgctgatgagttttggattggttgtgacatttgtgaacgatggtaccatggaaagtgtgtgaagataacaccagcaaaagctgaaagcatcaagcagtacaaatgcccttcttgcagcacaaagaaatctaggcactaa

SEQ ID NO: 8281 - protein, 233 aa, Populus balsamifera subsp. trichocarpa
  misc_feature (1)..(233): Ceres ANNOT ID NO.1518013
  misc_feature (1)..(233): Functional Homolog of  Ceres CLONE NO.156373 with e-value of 5.40E-102 and BLAST sequence identity of 81.8
  misc_feature (1)..(233): useful for making plants with altered flowering time as described in USSN 12/281,616
MASPRTVEEIFKDYNARRSALVRALTIEADEVYLQCDPEKENLCLYGHPNESWEVTLPAEEVPPELPEPALGINFARDGMTRKDWLSLVAVHSDSWLLSVGFYFGARLNRNERKRLFSMVNDLPTLFEIVTGRKPVEDKPSADGGSKSRNNTKRSTDGQARSNSKLSYVEDEDEHGDTLCGSCGGNYNADEFWIGCDICERWYHGKCVKITPAKAESIKQYKCPSCSTKKSRH

SEQ ID NO: 8282 - DNA, 1111 bp, Glycine max
  misc_feature (1)..(1111): Ceres CLONE ID no.477995
  misc_feature (1)..(1111): useful for making plants with altered flowering time as described in USSN 12/281,616
gctgtctgtcgttctatttaattcccctctccaaatttcaacctctgtctcctctccttaacagcatcatcacatgcacccgcgattcctacgatcccttcccatggtctcttctctgcaccctcgccgtaccttctagaaccttccctcagatctcaattccccttccgctttctcctttcatggaaatggcttccactccccgcaccgtcgaagagatcttcaaggactacaccgcccgcagaaccgccatcgttcgcgctctctctcaagatgtggatgaattctacggactctgcgatccagataaggagaacttgtgcctctatggacatccgaatgaaacatgggaggtgactttgccggcagaggaagttcctccggagcttccggagcctgcactcggaatcaattttgctagggatggcatgaaccgcagggactggctttctctggttgctgtgcacagtgattcgtggttgctctctgtggccttctatcttggagctcgtcttaaccgcaacgaaaggaaacgtttatttagcttgatcaatgatcttcctactgtttttgaagttgtgactgagaggaagccagtaaaggacaagcccactgcagacagtggaagcaagtctagaggcagcaccaagagatcaagtgatgggcaagttaagagcaacccaaagtttgcagatgatggttatgaagacgaggatgatgagcacagtgaaaccctttgtgggagctgtggcggaaattacaatgcagatgaattttggattggctgcgatatatgtgagaggtggttccatgggaaatgtgtgaagatcactcctgcaaaagctgagagcataaagcaatacaaatgtccatcatgcagcttgaggcgaggcaggccctaagccgaaggcaaaatgtgaagtgaataatgctgtttcatggccgacaaagatactgtaatattgttgtatcttttatagaagttcttgtaaacggtatagtatctatgtctgatcataatctttcagattaagttaatttcttctaccaagattaatcatcagtgtatgttatataattttatagaatagaattctatacattttatttt

SEQ ID NO: 8283 - protein, 239 aa, Glycine max
  misc_feature (1)..(239): Ceres CLONE ID NO.477995
  misc_feature (1)..(239): Functional Homolog of  Ceres CLONE NO.156373 with e-value of 1.80E-101 and BLAST sequence identity of 77.5
  misc_feature (1)..(239): useful for making plants with altered flowering time as described in USSN 12/281,616
MEMASTPRTVEEIFKDYTARRTAIVRALSQDVDEFYGLCDPDKENLCLYGHPNETWEVTLPAEEVPPELPEPALGINFARDGMNRRDWLSLVAVHSDSWLLSVAFYLGARLNRNERKRLFSLINDLPTVFEVVTERKPVKDKPTADSGSKSRGSTKRSSDGQVKSNPKFADDGYEDEDDEHSETLCGSCGGNYNADEFWIGCDICERWFHGKCVKITPAKAESIKQYKCPSCSLRRGRP

SEQ ID NO: 8284 - DNA, 1139 bp, Zea mays
  misc_feature (1)..(1139): Ceres CLONE ID no.486840
  misc_feature (1)..(1139): useful for making plants with altered flowering time as described in USSN 12/281,616
gtgtaaatagaagataggcgacgaacacgaagcaagcaaggcagccgaatcccaactcctgtgtgtgcctgccaacgcctcgtcggccgccgccgccgctgcttcgcccctctccgccagccgctcccgctcggagcacgccgccgccgacgtgggcgcgcaccgacggccgtcgtgtcgcatggatatggcccccgcggccgtctcctccaacccgcgctcggtcgaggaaatcttcaaagacttctccggtcggcgcgcggggctcgtccgcgccctcacctccgatgtggacgatttctgcagcttctgcgacccagataaggagaacttgtgtctctacggccttcccaacggtagctgggaggtctcgccgccggcggacgaggttcctccggagttgcccgagccggcgctcggcatcaactttgcgcgcgacggcatgcagcgccgcgactggctctcactcgtcgcggtccactctgactcgtggctcatctcagtcgccttcttctacggcgcccgcctcaacgccaacgaccggaagcgcttattcagcatgatcagtgatcttccttctgtctttgaagcatttgcggacaggaaacacgtcagggataggtctggcgttgatagcagcggcaagtccaggcactcatcaaagagaggaaacgatggccatgcgaagaactccagggcagcagctcctgctgccaaagagtacgacgacgacgatgacgaggaggacgaggaacacacggaaaccttttgtggaagctgcggcggcctctacaacgcgaacgagttctggatcggctgcgacatctgcgagcggtggttccacggcaagtgcgtgcggatcacccctgccaaagcggaccacataaagcactacaagtgcccggactgcagctcgaagaaaataaggcagtaggtcccagtgtgcaccgccggccatcgctgacctgtctgatcccaaaccatactccattgcttgcctgccttgccccaaggtcgcagttatcagatgcgcattccttcatttgtggggggttgttgtgtgatggatagcctggtaggaagaggcaaaggactgatatataatgactcgtttattgttcaaaaaaaaaaaaaaaaaa

SEQ ID NO: 8285 - protein, 248 aa, Zea mays
  misc_feature (1)..(248): Ceres CLONE ID NO.486840
  misc_feature (194)..(244): Pfam Name: PHD Pfam Description: PHD-finger
  misc_feature (1)..(248): Functional Homolog of  Ceres CLONE NO.156373 with e-value of 1.09E-89 and BLAST sequence identity of 67.7
  misc_feature (1)..(248): useful for making plants with altered flowering time as described in USSN 12/281,616
MAPAAVSSNPRSVEEIFKDFSGRRAGLVRALTSDVDDFCSFCDPDKENLCLYGLPNGSWEVSPPADEVPPELPEPALGINFARDGMQRRDWLSLVAVHSDSWLISVAFFYGARLNANDRKRLFSMISDLPSVFEAFADRKHVRDRSGVDSSGKSRHSSKRGNDGHAKNSRAAAPAAKEYDDDDDEEDEEHTETFCGSCGGLYNANEFWIGCDICERWFHGKCVRITPAKADHIKHYKCPDCSSKKIRQ

SEQ ID NO: 8286 - DNA, 1173 bp, Glycine max
  misc_feature (1)..(1173): Ceres CLONE ID no.525628
  misc_feature (1)..(1173): useful for making plants with altered flowering time as described in USSN 12/281,616
agtttattttttctctctttgatcaaattcccttcccatggtctctctctcttcaattaattccatttagctttccccaaatcccaaaccctttttcgcttagatcccaatccaattgggttatggacatggcttccagtccccgcactgtagaagagatcttcaaggattacagcgccagaagaacctctgttattcgcgctctcactcacgacgttgatgaattttacggcctctgtgatccagataaggataacctgtgcctctatggacatccaaatgaggcctgggaagtaactctgccagcggaggaagttccgccagagctcccggagccggctcttggaatcaattttgctagggatggcatgaaccgcagggactggctttctctggttgctgtccacagtgattcatggttggtttctgtggccttttaccttggggctcgtcttaaccgcaatgaaaggaaacgattatttagcttgatcaatgatcttccatctgtttttgaagttgtgactgacaggaaaccagttaaggacaagccaactgcggatagtggaagcaagtctaggggaagtgccaagagatctagcgatgggcaagttaaaagcaacccaaagtttgtagatgagggttatgaggaggatgaagatgagcataatgaaacactttgtggaagctgcggcggaaattacaacgctgatgagttttggatttgctgtgacatatgtgagaggtggttccatgggaagtgtgttaagattacccctgcaaaggctgagagcataaagcaatataaatgtccatcatgcagcctgaggcggggcaggccttagactgaaagaggcgatggaatgggtacatgtgaggtgagtgttgtttcatggctgacaagatactgtaattttgttacatcacttacagaagttaatgtaatgggcatagtatcgatgctcaagggcaaatttatcagggattaagtttgtttttccagatgaaccattggtgcatgccacagggtatagaatagaacatgacaaattttaattttatgattagtttatatttagtagaatatttgcttgaactttaaatattgtaatttttttatttttaacattgtttaagaaaacaaaccttttcaacaagaaaaaaaaaaaaaaaaaa

SEQ ID NO: 8287 - protein, 239 aa, Glycine max
  misc_feature (1)..(239): Ceres CLONE ID NO.525628
  misc_feature (185)..(235): Pfam Name: PHD Pfam Description: PHD-finger
  misc_feature (1)..(239): Functional Homolog of  Ceres CLONE NO.156373 BLAST sequence identity of 77.5
  misc_feature (1)..(239): useful for making plants with altered flowering time as described in USSN 12/281,616
MDMASSPRTVEEIFKDYSARRTSVIRALTHDVDEFYGLCDPDKDNLCLYGHPNEAWEVTLPAEEVPPELPEPALGINFARDGMNRRDWLSLVAVHSDSWLVSVAFYLGARLNRNERKRLFSLINDLPSVFEVVTDRKPVKDKPTADSGSKSRGSAKRSSDGQVKSNPKFVDEGYEEDEDEHNETLCGSCGGNYNADEFWICCDICERWFHGKCVKITPAKAESIKQYKCPSCSLRRGRP

SEQ ID NO: 8288 - DNA, 1262 bp, Glycine max
  misc_feature (1)..(1262): Ceres CLONE ID no.1170863
  misc_feature (1)..(1262): useful for making plants with altered flowering time as described in USSN 12/281,616
acttatacacattctattcttcaacaaacattgtagtttgatcaaattcccatggtctctctctctccaattaattcgatttagcttttccccaaatcccaaaccctttctttcgcttagatcccaatccaattgggttatggacatggcttccagtccccgcaccgttgaagagatcttcaaggattacggcgccagaagaactgccgttattcgcgctctcactcacgacgttgatgaattttacggcctctgtgatccagataaggataacctgtgcctctatggacatccaaatgaggcctgggaagtaactctgccagcggaggaagttccgccagagctccctgagcctgctcttggaatcaattttgctagggatggcatgaaccgcagggactggctttctcttgttgctgtgcacagtgattcgtggttggtttctgtggccttttacctcggggctcgtcttaaccgcaatgaaaggaaacgtttatttagcttgatcaatgatcttccatctgtttttgaagttgtgactgacaggaaaccagttaaggacaagccaactgcagatagtggaagcaagtctaggggaagtgccaagagatctagtgatgagcaagttaaaagcaacccaaagtttgtagatgagggttatgaggaggatgaagatgagcataatgaaacactttgtggaagctgtggcggaaattacaatgctgatgagttttggatttgctgtgacatatgtgagaggtggttccatgggaagtgtgttaagattacccctgcaaaggctgagagcataaagcaatataaatgtccatcatgcagcctgaggcggggcaggccatagactgaaggtgatggaatgggtacatgtgaggtgagtgttgtttcgtggttgacaagatactgtaactttgttacatcacttacagaagttcatgtaatgggcatagtattgatgcttaagggcaaatttatcagggattaagtttgtttttaccagatgaacgttgatggatgttacagagtatagaatagagcatggcaaattttaatttgatgattagtttatatttagttgaatatttgcttgaacttacatattgtaatttatttatttatttttaacattgtttaagaagacaaaaccttttcccctccacagattcttctaatcaaactttcattatgctgcttgatgggttaatgaaaagattatgtgagtggattcttgaaaaaaaaaaaaaaaa

SEQ ID NO: 8289 - protein, 239 aa, Glycine max
  misc_feature (1)..(239): Ceres CLONE ID NO.1170863
  misc_feature (185)..(235): Pfam Name: PHD Pfam Description: PHD-finger
  misc_feature (1)..(239): Functional Homolog of  Ceres CLONE NO.156373 with e-value of 1.80E-101 and BLAST sequence identity of 77.1
  misc_feature (1)..(239): useful for making plants with altered flowering time as described in USSN 12/281,616
MDMASSPRTVEEIFKDYGARRTAVIRALTHDVDEFYGLCDPDKDNLCLYGHPNEAWEVTLPAEEVPPELPEPALGINFARDGMNRRDWLSLVAVHSDSWLVSVAFYLGARLNRNERKRLFSLINDLPSVFEVVTDRKPVKDKPTADSGSKSRGSAKRSSDEQVKSNPKFVDEGYEEDEDEHNETLCGSCGGNYNADEFWICCDICERWFHGKCVKITPAKAESIKQYKCPSCSLRRGRP

SEQ ID NO: 8290 - DNA, 1142 bp, Zea mays
  misc_feature (1)..(1142): Ceres CLONE ID no.1393778
  misc_feature (1)..(1142): useful for making plants with altered flowering time as described in USSN 12/281,616
cttatgtttatgtcttcttcttctctccatctccttccaaagtctctctctctctctatcgcctttctctctctctctctctccacttccgaccacatcgggtctcagaaacccattgatgcggacctcgatctttctccactagctacagatctacacccttacacaaaccgtatatacatacacactttgtatctctctgtaaaatctatggccgccgtctcctctaaccctcgcaccgtcgaagagatcttcaaggattacaccgctcgtcgctccgccctcctccgtgctctaactaaagatgttgatgatttctactctcaatgcgatccggagaaggagaatttgtgtttgtatggacatccgaatgagtcgtgggaagtgaatctaccggcggaggaagttcctcctgagcttccggagcctgcgcttggtattaatttcgctagagatggtatgcagaggaaggattggctctcgcttgttgctgttcatagtgattgttggttgctctctgtttctttctactttggtgctcgccttaaccgcaacgagaggaagcggttgttcagtctgatcaacgatctcccaactctcttcgatgtagtgactggtaggaaacccatcaaagacaacaagccaagctcagattctggaagcaaatccagaaacggcactaagagatcaatagaagggcagacaaagagtccaacaccaagaccgatggaagagagctacgaggacgaggaagaagaagaagacgagcacggagacactctctgcggtatctgtggaggcaattatacgcaagatgagttctggatttgctgtgatgtttgtgaacgttggtaccatggaaaatgcgtgaagatcacccctgccaaagcagacagcatcaagcagtataaatgccctccttgctgtgcaaagaaaggaagacagtgattatgatcatcatcatcatcatcatctcccagagagactggttctcatgtcttaatattaatcatcctttttcttgtttcattaaccttttaatttcaaagcatacaaaaactctctctttagatcaccggaaagggattccaagaagttgagagagtgtagcaactgtttgagtatttttattcatataagag

SEQ ID NO: 8291 - protein, 245 aa, Zea mays
  misc_feature (1)..(245): Ceres CLONE ID NO.1393778
  misc_feature (191)..(241): Pfam Name: PHD Pfam Description: PHD-finger
  misc_feature (1)..(245): Functional Homolog of  Ceres CLONE NO.156373 with e-value of 4.09E-127 and BLAST sequence identity of 94.6
  misc_feature (1)..(245): useful for making plants with altered flowering time as described in USSN 12/281,616
MAAVSSNPRTVEEIFKDYTARRSALLRALTKDVDDFYSQCDPEKENLCLYGHPNESWEVNLPAEEVPPELPEPALGINFARDGMQRKDWLSLVAVHSDCWLLSVSFYFGARLNRNERKRLFSLINDLPTLFDVVTGRKPIKDNKPSSDSGSKSRNGTKRSIEGQTKSPTPRPMEESYEDEEEEEDEHGDTLCGICGGNYTQDEFWICCDVCERWYHGKCVKITPAKADSIKQYKCPPCCAKKGRQ

SEQ ID NO: 8292 - DNA, 1094 bp, Panicum virgatum
  misc_feature (1)..(1094): Ceres CLONE ID no.1826835
  misc_feature (1)..(1094): useful for making plants with altered flowering time as described in USSN 12/281,616
aactcctgtgtgccccgtcggccgcagcagctgcccgtccccgccgcctccggccgagcacgccgccgccaccgcctccggccgagcacgccgccgccaccgcctccggccgagcacgccgccgccaccgccggcgagggcgcgcgtcgacggcccgtccctttcgcatggatatgacccccgcgtccgtctcgtccaacccgcgctcggtcgaggaaatctacaaggacttctccggccgccgcgccggcctcgtccgcgccctcacctccgatgtggacgatttctacagctcctgcgacccagataaggagaatttgtgcctgtacggcctccccagcgggacctgggcggtggcgccgccagcggaggaggtgccgccggagatgccggagccggcgctcggtatcaacttcgcgcgggacggcatgcaacgccgggactggctctcactcgtcgcagtccactccgactcgtggctcatttccgtcgccttcttcttcggcgcacgcctcaacgccaacgatcggaagcgcttattcagtatggtcagtgatcttccatccgtctttgaagcattctcagacaggaaacacggcagagataggtctggcgttgatagcagcggcaagtctagacactcgtcaaagagaggaagcgacggccacgtgaagaattctagagcagcagctcctgctgccaaacagtacgatgatgatgatgacgaagacgacgaggagcacaccgagaccttttgcgggacctgcggtggcctgtacaattcgaacgagttctggatcggctgcgacatctgcgagaggtggttccatggcaagtgcgtgcggattacccccgctcgagcggaccacataaagcactacaagtgcccggactgcagctcgaagaaaatgaggcagtagtagtgggggggcgtctgatctgatcaaaaccatactcctgttgtctgtccgcagctagcagatgtgaattcgttttagaaacgttgttgtggtgttgtgtggtggtgataggaagaggcagaggacagaatagatacatgctcgttgctcgttcaaaaaaaaaaaaaaaaaaaa

SEQ ID NO: 8293 - protein, 248 aa, Panicum virgatum
  misc_feature (1)..(248): Ceres CLONE ID NO.1826835
  misc_feature (194)..(244): Pfam Name: PHD Pfam Description: PHD-finger
  misc_feature (1)..(248): Functional Homolog of  Ceres CLONE NO.156373 with e-value of 2.29E-87 and BLAST sequence identity of 64.0
  misc_feature (1)..(248): useful for making plants with altered flowering time as described in USSN 12/281,616
MTPASVSSNPRSVEEIYKDFSGRRAGLVRALTSDVDDFYSSCDPDKENLCLYGLPSGTWAVAPPAEEVPPEMPEPALGINFARDGMQRRDWLSLVAVHSDSWLISVAFFFGARLNANDRKRLFSMVSDLPSVFEAFSDRKHGRDRSGVDSSGKSRHSSKRGSDGHVKNSRAAAPAAKQYDDDDDEDDEEHTETFCGTCGGLYNSNEFWIGCDICERWFHGKCVRITPARADHIKHYKCPDCSSKKMRQ

SEQ ID NO: 8294 - DNA, 1092 bp, Gossypium hirsutum
  misc_feature (1)..(1092): Ceres CLONE ID no.1834120
  misc_feature (1)..(1092): useful for making plants with altered flowering time as described in USSN 12/281,616
aaaagagtaccaatggcatattgcttgccatttgtataacatagagaaaaagaaatttattaggccattaattccaatccatggcttcctctgctcgaaccgttgaggaaatcttcaaagattacactgctcgaagaaccgccatccttcgtgctttaactttggatgtagatcacttttatggactctgtggtccagatagagagaatttatgcctttatgggcatccgaatgaaagctgggaagttagtctgccagcagaagaagttccagcagagcttcctgagcccgcccttggtatcaatttcgctagagatggaatgaaccgtaaagattggttgtccttggttgctgtccatagtgattcctggttgatttccctcgctttctaccttgctgctcgtcttaaccgtaatgaaaggaaacgtctatttagtatgatgaacgatctgcctacagtctttgaggttgtaactgaaaggaaacctgttaaagataaaccaagtatagagagtgggagcaaatctcagggcagcactaagagatcgagtgatggacaagtgaaaagcaatcctaagattgctgatgcggattacgaggataatgaagatgaacacggagaaacactatgcggtagctgcggtggaaatttcaatgcggatgagttttggattgggtgtgatgtttgtgagaggtggttccatggaaaatgtgttaaaataacaccagctaaagctgagagcattaagcagtataaatgcccatcttgcagcatgaggagcggcaggcactgatagtcggaaatggtaagaacaggacatgatccatctcaatggctgacaaagtagtatagcaaatactcgtgttaggtaactaatgtttgaagtttatatcatcaaaatgtaagtttatgatagatgatttgaagtcaatggaagttctacttccttactgatacctttatttgcattcaactcattagaatttgttaatttgtagcaatttgtccgtacgctggcacattgaggtggtcttttagacctaagagatcgattgaatttaaaacgttccgaaaaaaaaaaaaaaaaaaaa

SEQ ID NO: 8295 - protein, 237 aa, Gossypium hirsutum
  misc_feature (1)..(237): Ceres CLONE ID NO.1834120
  misc_feature (183)..(233): Pfam Name: PHD Pfam Description: PHD-finger
  misc_feature (1)..(237): Functional Homolog of  Ceres CLONE NO.156373 with e-value of 6.49E-97 and BLAST sequence identity of 75.4
  misc_feature (1)..(237): useful for making plants with altered flowering time as described in USSN 12/281,616
MASSARTVEEIFKDYTARRTAILRALTLDVDHFYGLCGPDRENLCLYGHPNESWEVSLPAEEVPAELPEPALGINFARDGMNRKDWLSLVAVHSDSWLISLAFYLAARLNRNERKRLFSMMNDLPTVFEVVTERKPVKDKPSIESGSKSQGSTKRSSDGQVKSNPKIADADYEDNEDEHGETLCGSCGGNFNADEFWIGCDVCERWFHGKCVKITPAKAESIKQYKCPSCSMRSGRH

SEQ ID NO: 8296 - DNA, 698 bp, Gossypium hirsutum
  misc_feature (1)..(698): Ceres CLONE ID no.1930415
  misc_feature (1)..(698): useful for making plants with altered flowering time as described in USSN 12/281,616
ataatacaatctttattttggagaaaaagaaaaaaaagtatggctttttctagtcctcgcactgtggaagagatcttcaaagactatagcgctcgacgctccggtcttgttcgtgctctcacttacgatgtagatgatttctactcgcaatgcgatccagataaggagaatttgtgtctgtatggacacccaaatgaggcttgggaggtagctttaccagcagaggaagttccacctgagctccctgagccagccttgggtatcaattttgctagagatgggatgaaccggaaagactggctttcactggttgctgtgcatagtgattgttggttgctttccgtgtctttctactttggagctcggcttaatcgcaatgaaaggaagcgcttatttagcatgataaacgatcttccaactgtctttgaagttgtaactggaaggaagcccataaaagacaagcccacagtagaaagtggaagcaaatcgcgaaacagcacgaagagatcaattgatggacagccaagaagcaatcctaagttagttgatgaaaattatgaggaggatgaagaagagcagggcgataccttttgcgggatttgtggtggaggatacaattctgatgagttttggatcggttgtgacaactgtgaacggtggtaccatggaaagtgcgtgaagataacaccagccaaggc

SEQ ID NO: 8297 - protein, 237 aa, Gossypium hirsutum
  misc_feature (1)..(237): Ceres CLONE ID NO.1930415
  misc_feature (1)..(237): Functional Homolog of  Ceres CLONE NO.156373 with e-value of 1.19E-104 and BLAST sequence identity of 83.3
  misc_feature (1)..(237): useful for making plants with altered flowering time as described in USSN 12/281,616
MAFSSPRTVEEIFKDYSARRSGLVRALTYDVDDFYSQCDPDKENLCLYGHPNEAWEVALPAEEVPPELPEPALGINFARDGMNRKDWLSLVAVHSDCWLLSVSFYFGARLNRNERKRLFSMINDLPTVFEVVTGRKPIKDKPTVESGSKSRNSTKRSIDGQPRSNPKLVDENYEEDEEEQGDTFCGICGGGYNSDEFWIGCDNCERWYHGKCVKITPAKAELIKFYKCPLCTKKARQ

SEQ ID NO: 8298 - protein, 257 aa, Medicago sativa; identical to SEQ ID NO: 7280
  misc_feature (1)..(257): Public GI ID NO.12651665
  misc_feature (202)..(252): Pfam Name: PHD Pfam Description: PHD-finger
  misc_feature (1)..(257): Functional Homolog of  Ceres CLONE NO.156373 with e-value of 1.49E-83 and BLAST sequence identity of 67.3
  misc_feature (1)..(257): useful for making plants with altered flowering time as described in USSN 12/281,616

SEQ ID NO: 8299 - protein, 244 aa, Oryza sativa
  misc_feature (1)..(244): Public GI ID NO.34900462
  misc_feature (189)..(239): Pfam Name: PHD Pfam Description: PHD-finger
  misc_feature (1)..(244): Functional Homolog of  Ceres CLONE NO.156373 and BLAST sequence identity of 71.7
  misc_feature (1)..(244): useful for making plants with altered flowering time as described in USSN 12/281,616
MEMAAPVSPAPRTVEDIFKDFSGRRAGLVRALTVDVDEFYGFCDPEKENLCLYGHPNGRWEVALPAEEVPPELPEPALGINFARDGMHRRDWLSLVAVHSDSWLLSVAFFFGARLNGNERKRLFSLINDHPTVLEALSDRKHGRDNKSGADNGSKSRHSGKRANDVQTKTSRPAVVDDGYDEEEHSETLCGTCGGRYNANEFWIGCDICERWFHGKCVRITPAKAEHIKHYKCPDCSSSKKSRQ

SEQ ID NO: 8300 - protein, 245 aa, Lycopersicon esculentum
  misc_feature (1)..(245): Public GI ID NO.45387429
  misc_feature (1)..(245): Functional Homolog of  Ceres CLONE NO.156373 BLAST identity of 72.2
  misc_feature (1)..(245): useful for making plants with altered flowering time as described in USSN 12/281,616
MATNSSSHSPRTVEEIFKDFSARHAAVLRALTTDVEDFYSQCDPERDNLCLYGHPNESWEVAVPAEEVPPELPEPVLGINFARDGMERRDWLSLVAMHTDSWLLSVAFYFGARLNRNERSRVFTLINDLPTVFEAVTGRKPLKDKPSVDSGKKSKNNAKREKQMKANQRLQEESDDEDEGNEDEHEETLCGSCGTNGNEDEFWIGCDMCEKWYHGKCVKITPAKAQSIKEYRCPSCSNKRAKHMA

SEQ ID NO: 8301 - protein, 248 aa, Solanum tuberosum
  misc_feature (1)..(248): Public GI ID NO.63028790
  misc_feature (194)..(244): Pfam Name: PHD Pfam Description: PHD-finger
  misc_feature (1)..(248): Functional Homolog of  Ceres CLONE NO.156373 identity of identity of 68.6
  misc_feature (1)..(248): useful for making plants with altered flowering time as described in USSN 12/281,616
MENSVPRTVEEVFSDFKSRRAALIKALTTDVEKFYQQCDPEKENLCLYGLPNETWEVNLPVEEVPPELPEPALGINFARDGMQEKDWLSLVAVHSDSWLLSVAFYFGARFGFGKSERKRLFQMINDLPTVFEVVTGAAKQTRDPPHNNSNKSKSSGKPRQPESQLKAVKVSPPKMENDSGEEEEEEEDEQGATLCGACGDNYATDEFWICCDICERWFHGKCVKITPAKAEHIKQYKCPSCSSKRAKV

SEQ ID NO: 8302 - protein, 252 aa, Arabidopsis pumila
  misc_feature (1)..(252): Public GI ID NO.75214624
  misc_feature (1)..(252): Functional Homolog of  Ceres CLONE NO.156373 BLAST identity of 64.5
  misc_feature (1)..(252): useful for making plants with altered flowering time as described in USSN 12/281,616
MEGGAALYNPRTVEEVFKDFKGRRAAIVKALTTDVQEFYQQCDPEKENLCLYGLPNEEWEVNLPAEEVPPELPEPALGINFARDGLSEKEWLSLVAIHSDAWLLSVSFYFGSRFSFHKEDRKRLFNMINDVPTIFEVVTGMAKKQSKDKSSSANQNGNKSKSNSKVRTSDGKSSKAMQVKDEDEEVDEEDEDDHGETLCGACGDSDGADEFWICCDLCEKWFHGKCVKITPARAEHIKQYKCPSCSNKRARA

SEQ ID NO: 8303 - protein, 241 aa, Arabidopsis thaliana
  misc_feature (1)..(241): Public GI ID NO.15239180
  misc_feature (187)..(237): Pfam Name: PHD Pfam Description: PHD-finger
  misc_feature (1)..(241): Functional Homolog of  Ceres CLONE NO.156373 and BLAST sequence identity of 88.3
  misc_feature (1)..(241): useful for making plants with altered flowering time as described in USSN 12/281,616
MAAESSNPRTVEEIFKDFSGRRSGFLRALSVDVDKFYSLCDPEMENLCLYGHPNGTWEVNLPAEEVPPELPEPALGINFARDGMQRKDWLSLVAVHSDCWLLSVSSYFGARLNRNERKRLFSLINDLPTLFEVVTGRKPIKDGKPSMDLGSKSRNGVKRSIEGQTKSTPKLMEESYEDEDDEHGDTLCGSCGGNYTNDEFWICCDVCERWYHGKCVKITPAKAESIKQYKCPSCCTKKGRQ

SEQ ID NO: 8304 - DNA, 1148 bp, Glycine max
  misc_feature (1)..(1148): Ceres Clone ID no.513477
  misc_feature (1)..(1148): useful for making plants with altered flowering time as described in USSN 12/281,616
aacacacacaattatctcatcacaacaactactagctacgtactactactttgcctagcttctctttcttttttcttttctctctccccccttttgcgctaaacttcactctctcttctatatcaagggttgatcacagaacctcaatatatttctaataataattgataaagtttgagttattgtttcgagacaaagaaaaagagagagagagagagagatatgggtagagggagagttgagctgaagaggatagagaacaaaatcaaccgccaagtaactttctcaaaaagaaggaacggtttgctcaagaaagcctatgagctctcagttctctgtgatgctgaggttgctctcatcattttctcaagccgtggcaagctctatgaatttggaagtgttgggactaccaaaactattgagcgataccatcgtagctcttttactcctcaagacgaacacgttgaatgtgaaactcagagctggtaccaagaggtatcaaagctaaaggcaaagtatgattctcttcaaaggacccagaggcatttgcttggggaagatcttggaccattgaacataaaggagctgcagaatcttgagaaacagcttgaaggggctttagcacaagcaaggcaaaggaagacacaaatcatgattgaacaaatggaagagcttcgcagaagggagcgccatcttggagacatgaataagcaactgagactcaagcttgaagcagagggatttaatcttaaagctatggaaagcttgttgagctctacttcagaagctggaaatagtggctttcactttcagcagcctcctcaaaccaatcctatggattaccagcaggcagaaccctttttgcaaatagggtaccatcaatatgttcaagctgaggcttctaatgttccaaagagcatggcttgtgaaactaatttcatgcagggatggatcctttgatcaatcttattgaattaagtatatgatgatttaccttattgtctatatgctttttagatttgtgttttggatgttgttaaatgtaactttgtgaccagaaaagttgcagacttgtttagcactttctgtaattggacacaagtacagacaatggtttaactatatgttaaagtaatgctattgttttt

SEQ ID NO: 8305 - protein, 245 aa, Glycine max
  misc_feature (1)..(245): Ceres Clone ID no.513477
  misc_feature (9)..(59): Pfam Name: SRF-TF Pfam Description: SRF-type transcription factor
  misc_feature (1)..(245): Functional Homolog of  Ceres CLONE NO.241491 with e-value of 9.80e-76 and BLAST sequence identity of 67.8
  misc_feature (1)..(245): useful for making plants with altered flowering time as described in USSN 12/281,616
MGRGRVELKRIENKINRQVTFSKRRNGLLKKAYELSVLCDAEVALIIFSSRGKLYEFGSVGTTKTIERYHRSSFTPQDEHVECETQSWYQEVSKLKAKYDSLQRTQRHLLGEDLGPLNIKELQNLEKQLEGALAQARQRKTQIMIEQMEELRRRERHLGDMNKQLRLKLEAEGFNLKAMESLLSSTSEAGNSGFHFQQPPQTNPMDYQQAEPFLQIGYHQYVQAEASNVPKSMACETNFMQGWIL

SEQ ID NO: 8306 - DNA, 1262 bp, Zea mays
  misc_feature (1)..(1262): Ceres Clone ID no.380978
  misc_feature (1)..(1262): useful for making plants with altered flowering time as described in USSN 12/281,616
cccgagccggctcattatatcgtccgtcgcgcagacaacgcaagtttgctagcggccggatcagcagccacagcgcgaagagagcaaccacgctgcacacagaggcgccgtgtgtgagatagagcaagctcgatcgaaggaaggagggaagctagagatcgtacgttcgccatggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccggcataacaaaaactttagaaaggtaccaacattgctgctacaatgctcaagattccaatggcgcactctctgaaactcagagctggtaccaggaaatgtcaaaactgagggcaaaattcgaggccttgcagcgcactcagaggcacttgcttggggaggaacttggcccactgagtgtgaaggagttgcagcagctagagaaacagctcgaatgtgctttgtcacaggcaagacagagaaagacacaacttatgatggagcaagtggaagagctccgcagaaaggagcgacacctgggagaaatgaacaggcaactcaaacacaagcttgaagctgaaggttgtagcaactacagaaccctgcagcatgcagcctggccagctcccggcagcaccatggtggagcatgacggcgccacctatcatgtgcatccaacaactgctcaatcggttgcaatggactgtgaacccactctgcaaatcgggtaccctcctcatcaccagtttctgccttccgaggcagccaataatatcccaaggagcccccctggaggcgagaacaacttcatgctgggatgggttctttgagttgctctgttaatcatccatccatcagatggatgtccaaactaataaaaggcactcagtgctaccatatgcatatccatgcttaagtgcttgatttgccacgacgtggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttatt

SEQ ID NO: 8307 - protein, 255 aa, Zea mays; identical to SEQ ID NO: 7811
  misc_feature (1)..(255): Ceres Clone ID no.380978
  misc_feature (9)..(59): Pfam Name: SRF-TF Pfam Description: SRF-type transcription factor
  misc_feature (1)..(255): Functional Homolog of  Ceres CLONE NO.241491 with e-value of 3.30e-119 and BLAST sequence identity of 92.9
  misc_feature (1)..(255): useful for making plants with altered flowering time as described in USSN 12/281,616

SEQ ID NO: 8308 - DNA, 900 bp, Oryza sativa
  misc_feature (1)..(900): Public gi NO.50911963
  misc_feature (1)..(900): useful for making plants with altered flowering time as described in USSN 12/281,616
atggactccgactggctcaagggcatcgtccccgaggagcacgggatggggtcgtcgtcgccgtcggcggagctgatcgcgtgcccgcgggcgccgatgcaggcggcggcggcggcggccgaccgccggcttcgcccccagcacgaccagccgctcaagtgcccgcggtgcgagtcgacgcacaccaagttctgctactacaataactacagcctctcgcagccgcgctacttctgcaagacgtgccgccgctactggaccaagggcggctcgctccggaacgtccccgtcggcggcggctgccgcaagaacaagcgcgcgccgcccaagaaggccgccgcccacgcccagcccgcggtggcggtggcggcggcgctgcaaggccgccacatggagaccggactccacctgtccttctccgggatgcagcatcatcttgcgccgccgccgccggcggcggccaccgcggccgacccgctctgcagccttggactatttgactggaagcagtacgaccccgtcttcgccggctccggtggcggcggctcccccgtggcggcgctggagagcgctggtggctcggaggcgcagttcatgggtgctggcatgatgggcattggcggcggcggcgtcgcggagtaccatgcgctgagcgcgctccggttcgcggcagggctcggcgatcacctggcgctgccgttcggcgcggtgcgggcggagcacgacgccgtcgaggtgaagccggtggcggcggagaggctgctgtcgctcgagtggtgcggcgaggcgagccgcacggcggcgccggagagctccattagctcgctgggcgggctgggactgtggagcggcatgatcggcggcgggcaccatcaccatggctcctccgctgccatctga

SEQ ID NO: 8309 - protein, 299 aa, Oryza sativa; identical to SEQ ID NO: 8036
  misc_feature (1)..(299): Public gi NO.50911963
  misc_feature (1)..(299): Functional Homolog of  Ceres ANNOT ID NO.543998 with e-value of 1.00e-23 and BLAST sequence identity of 85.2
  misc_feature (1)..(299): useful for making plants with altered flowering time as described in USSN 12/281,616

SEQ ID NO: 8310 - DNA, 1683 bp, Triticum aestivum
  misc_feature (1)..(1683): Ceres CLONE ID no.751992
  misc_feature (1)..(1683): useful for making plants with altered flowering time as described in USSN 12/281,616
cccctctctccctctgtatcctgcacacaccgccaccgatcactcgccggagcccctccccccaatggccsccgcgcgccgccgcgatcgcgtgatggccgacccagccgctcgccgaagatggacgaagccggaagggcctccgctcccgcggtggtgacggtcacggcctccgccgccgccccctcgcctcctcctcccccgccccccgccaccggccaccgccgcggccgccgacccgccatcgcccgacccggacgctctctatgaagagggaatgtggcagcagatggccatgagcagcggcgccactatgcaatctgggccatatcctgtgcggccaggggaaccggactgcacctactacctcaggactggattgtgcaggttcggcatgagctgcaggttcaatcaccctcaggacaggaatacggctattgcctctgccagaatgaaaggagaatatcctgagagggtgggacaacctgaatgtcagtactatctgaagactggaacatgcaagtttgggcctacgtgcaaattccatcaccctagagaaaaggctggaatcgcaggaatggtgcagctaaacacattgggatatccacttcgaccgaatgaaagggagtgtgcatactacttaaaaacgggacagtgtaaatatgggaatacatgtaaatttaaccatccagaaattttcaatgcggtggcttcttcacgtggttcccctatttatcctcctgtacataactctggaagcaccggtccacattcctatactggaacaatggcaagctggacttatccaagaggttctttcattccaagccctagatggcaaagtccttcaaactatacaccgatgattgtaccacagggtcttgttcaagtaccaaactggaactcatatcctggccaaatggtacctgtttcatctcctgagagtcgactacagtctccaggggctcaacaatactatggaacttctcgacaaggtgaagccagygcaggaaatcagggaatgcaatcaycctacagatccagttcgtttcctgcacctcagtatgcactgcagagagagaatgtatttcctgagagacctgatcagccagaatgcatatactacataaagactggagattgtaaatttggtgcggtttkmaaattccatcatccccgggtgcgctcacagcctcccccagactgtatcttgagcccaatgggtcttccattacgcccaggcgaagagctctgcaagttctactctcgctatggcatctgcaagttcggcgtaaactgcaagttcgaccatccaatggcggctccgatgggggtctacgcgtacggctactctgcctcggcgtcgcccaacgcgcccatggggtcggcgtctcctggagtccccctccgggtctgcgtacgcctcctaaggcaaggctccctggcatttgaccctaccttgattgatctcgatgatgtataaaagccatcgcgagctgtcgtccctccctcgggcgcgccccgcgaatgttctcccccctaactccccggaatcaagttctgtaaaaatcgagtttgctaccagagatgtacagttgttatttttgttaatgcgggtcagtgtttggatggatggagaarccatttgctaccgaatgaaataatgcttgaatgcagtgtttg

SEQ ID NO: 8311 - protein, 401 aa, Triticum aestivum
  misc_feature (1)..(401): Ceres CLONE ID no.751992
  misc_feature (1)..(401): Functional Homolog of  Ceres ANNOT ID NO.149496 with e-value of 1.40e-63 and BLAST sequence identity of 47.4
  misc_feature (243)..(243): Xaa can be any naturally occurring amino acid
  misc_feature (252)..(252): Xaa can be any naturally occurring amino acid
  misc_feature (295)..(295): Xaa can be any naturally occurring amino acid
  misc_feature (1)..(401): useful for making plants with altered flowering time as described in USSN 12/281,616
MWQQMAMSSGATMQSGPYPVRPGEPDCTYYLRTGLCRFGMSCRFNHPQDRNTAIASARMKGEYPERVGQPECQYYLKTGTCKFGPTCKFHHPREKAGIAGMVQLNTLGYPLRPNERECAYYLKTGQCKYGNTCKFNHPEIFNAVASSRGSPIYPPVHNSGSTGPHSYTGTMASWTYPRGSFIPSPRWQSPSNYTPMIVPQGLVQVPNWNSYPGQMVPVSSPESRLQSPGAQQYYGTSRQGEAXAGNQGMQSXYRSSSFPAPQYALQRENVFPERPDQPECIYYIKTGDCKFGAVXKFHHPRVRSQPPPDCILSPMGLPLRPGEELCKFYSRYGICKFGVNCKFDHPMAAPMGVYAYGYSASASPNAPMGSASPGVPLRVCVRLLRQGSLAFDPTLIDLDDV
